(12) United States Patent
Purcell et al.

(10) Patent No.: US 10,392,432 B2
(45) Date of Patent: Aug. 27, 2019

(54) HUMAN ANTIBODIES TO INFLUENZA HEMAGGLUTININ

(71) Applicant: Regeneron Pharmaceuticals, Inc., Tarrytown, NY (US)

(72) Inventors: Lisa A. Purcell, Garnerville, NY (US); Jonathan Viau, White Plains, NY (US); William Olson, Yorktown Heights, NY (US)

(73) Assignee: REGENERON PHARMACEUTICALS, INC., Tarrytown, NY (US)

( * ) Notice: Subject to any disclaimer, the term of this patent is extended or adjusted under 35 U.S.C. 154(b) by 325 days.

(21) Appl. No.: 14/974,361

(22) Filed: Dec. 18, 2015

(65) Prior Publication Data

US 2016/0176953 A1   Jun. 23, 2016

Related U.S. Application Data

(60) Provisional application No. 62/094,752, filed on Dec. 19, 2014, provisional application No. 62/152,122, filed on Apr. 24, 2015.

(51) Int. Cl.
| | |
|---|---|
| *A61K 39/42* | (2006.01) |
| *C07K 16/10* | (2006.01) |
| *A61K 31/215* | (2006.01) |
| *A61K 39/00* | (2006.01) |

(52) U.S. Cl.
CPC ........ *C07K 16/1018* (2013.01); *A61K 31/215* (2013.01); *A61K 39/42* (2013.01); *A61K 2039/505* (2013.01); *A61K 2039/507* (2013.01); *A61K 2039/545* (2013.01); *A61K 2300/00* (2013.01); *C07K 2317/21* (2013.01); *C07K 2317/33* (2013.01); *C07K 2317/565* (2013.01); *C07K 2317/734* (2013.01); *C07K 2317/76* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| | | | |
|---|---|---|---|
| 5,589,174 A | 12/1996 | Okuno et al. | |
| 5,631,350 A | 5/1997 | Okuno et al. | |
| 6,596,541 B2 | 7/2003 | Murphy et al. | |
| 7,582,298 B2 | 9/2009 | Stevens et al. | |
| 8,124,092 B2 | 2/2012 | Lanzavecchia | |
| 8,192,927 B2 | 6/2012 | Van Den Brink et al. | |
| 8,246,995 B2 | 8/2012 | Dai et al. | |
| 8,257,740 B1 | 9/2012 | Sung et al. | |
| 8,383,121 B2 | 2/2013 | Qian et al. | |
| 8,444,986 B2 | 5/2013 | Qian et al. | |
| 8,470,327 B2 | 6/2013 | Throsby et al. | |
| 8,540,994 B2 | 9/2013 | Ho et al. | |
| 8,540,995 B2 | 9/2013 | Mookkan et al. | |
| 8,540,996 B2 | 9/2013 | Qian et al. | |
| 8,574,581 B2 | 11/2013 | Qian et al. | |
| 8,574,830 B2 | 11/2013 | Mookkan et al. | |
| 8,603,467 B2 | 12/2013 | Chen et al. | |
| 8,637,644 B2 | 1/2014 | Ho et al. | |
| 8,637,645 B2 | 1/2014 | Ho et al. | |
| 8,658,354 B2 | 2/2014 | Kida et al. | |
| 8,669,046 B2 | 3/2014 | Li et al. | |
| 8,685,402 B2 | 4/2014 | Lanzavecchia | |
| 8,691,223 B2 | 4/2014 | Van Den Brink et al. | |
| 8,784,819 B2 | 7/2014 | Yusibov et al. | |
| 8,871,207 B2 | 10/2014 | Lanzavecchia | |
| 8,975,378 B2 | 3/2015 | Ikota et al. | |
| 2004/0101920 A1 | 5/2004 | Radziejewski et al. | |
| 2009/0092620 A1 | 4/2009 | Moste et al. | |
| 2010/0080813 A1 | 4/2010 | Lanzavecchia | |
| 2010/0331527 A1 | 12/2010 | Davis et al. | |
| 2011/0053142 A1 | 3/2011 | Mookkan et al. | |
| 2011/0070235 A1 | 3/2011 | Grandea, III et al. | |

(Continued)

FOREIGN PATENT DOCUMENTS

| | | |
|---|---|---|
| WO | 2009/121004 A2 | 1/2009 |
| WO | 2010/027818 A2 | 3/2010 |

(Continued)

OTHER PUBLICATIONS

Wrammert et al., Rapid cloning of high-affinity human monoclonal antibodies against influenza virus, 2008, Nature, vol. 453, pp. 667-671.*

Abdiche et al. (2008) "Determining kinetics and affinities of protein interactions using a parallel real-time label-free biosensor, the Octet" Analytical Biochemistry, 377:209-217.

Al-Lazikani et al. (1997) "Standard Conformations for the Canonical Structures of Immunoglobulins" J. Mol. Biol. 273:927-948.

Altschul et al. (1990) "Basic Local Alignment Search Tool" J. Mol. Biol. 215: 403-410.

Altschul et al. (1997) "Gapped BLAST and PSI-BLAST: A New Generation of Protein Database Search Programs" Nucleic Acids Res. 25:3389-3402.

(Continued)

*Primary Examiner* — Benjamin P Blumel
(74) *Attorney, Agent, or Firm* — FisherBroyles, LLP; Cara L. Crowley-Weber; Thomas Triolo

(57) ABSTRACT

The present invention provides monoclonal antibodies, or antigen-binding fragments thereof, that bind to the influenza hemagglutinin (HA) protein, pharmaceutical compositions comprising the antibodies and methods of use. The antibodies of the invention are useful for inhibiting or neutralizing influenza virus activity, thus providing a means of treating or preventing influenza infection in humans. In some embodiments, the invention provides for use of one or more antibodies that bind to the influenza HA for preventing viral attachment and/or entry into host cells. The antibodies of the invention may be used prophylactically or therapeutically and may be used alone or in combination with one or more other anti-viral agents or vaccines.

16 Claims, 4 Drawing Sheets

Specification includes a Sequence Listing.

(56) References Cited

U.S. PATENT DOCUMENTS

| | | |
|---|---|---|
| 2011/0076265 A1 | 3/2011 | Burioni et al. |
| 2011/0014187 A1 | 6/2011 | Burioni et al. |
| 2011/0195454 A1 | 8/2011 | McWhirter et al. |
| 2011/0256141 A1 | 10/2011 | Mookkan et al. |
| 2011/0274702 A1 | 11/2011 | Lanzavecchia |
| 2011/0319600 A1 | 12/2011 | Ikota et al. |
| 2012/0020971 A1 | 1/2012 | Kauvar et al. |
| 2012/0039899 A1 | 2/2012 | Olsen et al. |
| 2012/0058124 A1 | 3/2012 | Kurosawa et al. |
| 2012/0100142 A1 | 4/2012 | Crowe, Jr. et al. |
| 2012/0100150 A1 | 4/2012 | Jiang et al. |
| 2012/0128671 A1 | 5/2012 | Horowitz et al. |
| 2012/0207760 A1 | 8/2012 | Grandea, III et al. |
| 2012/0276115 A1 | 11/2012 | Van Den Brink et al. |
| 2012/0315323 A1 | 12/2012 | Yusibov et al. |
| 2013/0004505 A1 | 1/2013 | Chang et al. |
| 2013/0022608 A1 | 1/2013 | Burioni et al. |
| 2013/0202608 A1 | 8/2013 | Mookkan et al. |
| 2013/0243792 A1 | 9/2013 | Vogels et al. |
| 2013/0251715 A1 | 9/2013 | Chan et al. |
| 2013/0289246 A1 | 10/2013 | Crowe et al. |
| 2013/0302348 A1 | 11/2013 | Raguram et al. |
| 2013/0302349 A1 | 11/2013 | Shriver et al. |
| 2013/0309248 A1 | 11/2013 | Throsby et al. |
| 2014/0011982 A1 | 1/2014 | Marasco et al. |
| 2014/0065156 A1 | 3/2014 | Van Den Brink et al. |
| 2014/0065165 A1 | 3/2014 | Vogels et al. |
| 2014/0086927 A1 | 3/2014 | Kurosawa et al. |
| 2014/0120113 A1 | 5/2014 | Kwaks et al. |
| 2014/0161822 A1 | 6/2014 | Xu et al. |
| 2014/0170163 A1 | 6/2014 | Garcia-Sastre et al. |

FOREIGN PATENT DOCUMENTS

| | | |
|---|---|---|
| WO | 2010/130636 A1 | 11/2010 |
| WO | 2013/007770 A1 | 1/2013 |
| WO | 2013/011347 A1 | 1/2013 |
| WO | 2013/081463 A2 | 6/2013 |
| WO | 2014/158001 A1 | 10/2014 |
| WO | 2015/051010 A1 | 4/2015 |

OTHER PUBLICATIONS

Arruebo et al. (2009) "Antibody-Conjugated Nanoparticles for Biomedical Applications" J. Nanomat. 2009:1-24.

Corti et al. (2011) "A Neutralizing Antibody Selected from Plasma Cells That Binds to Group 1 and Group 2 Influenza A Hemagglutinins" Science 333:850-855.

Dreyfus et al. (2012) "Highly Conserved Protective Epitopes on Influenza B Viruses" Science 337(6100):1343-1348.

Ehring (1999) "Hydorgen Exchange/Electrospray Ionization Mass Spectrometry Studies of Structural Features of Protein/Protein Interactions" Analytical Biochemistry 267: 252-259.

Ekiert et al. (2011) "A Highly Conserved Neutralizing Epitope on Group 2 Influenza A Viruses" Science 333 (6044):843-850.

Engen and Smith (2001) "The Basics of Ion Chromatography," Anal. Chem. 73:256A-265A.

Gonnet et al. (1992) "Exhaustive Matching of the Entire Protein Sequence Database" Science 256:1443 45.

Good et al. (1991) "Historic Aspects of Intravenous Immunoglobulin Therapy," Cancer 68:1415-1421.

Junghans et al. (1990) "Anti-Tac-H, a Humanized Antibody to the Interleukin 2 Receptor with New Features for Immunotherapy in Malignant and Immune Disorders" Cancer Res. 1990 50:1495-1502.

Kazane et al. (2013) "Self-Assembled Antibody Multimers through Peptide Nucleic Acid Conjugation" J. Am. Chem. Soc. 135(1):340-346.

Khurana et al. (2013) "DNA Priming Prior to Inactivated Influenza (H5N1) Vaccination Expands the Antibody Epitope Repertoire and Increases Affinity Maturation in a Boost-Interval—Dependent Manner in Adults" J. Infect. Dis. 208:413-417.

Klein et al. (2012) "Progress in Overcoming the Chain Association Issue in Bispecific Heterodimeric IgG Antibodies" mAbs 4:6, 1-11.

Kufer et al. (2004) A Revival of Bispecific Antibodies Trends Biotechnol. 22:238-244.

Langer (1990) "New Methods of Drug Delivery," Science 249:1527-1533.

Ledgerwood et al. (2011) DNA priming and influenza vaccine immunogenicity: two phase 1 open label randomised clinical trials Lancet Infect. Dis. 11:916-924.

Ledgerwood et al. (2013) "Prime-Boost Interval Matters: A Randomized Phase 1 Study to Identify the Minimum Interval Necessary to Observe the H5 DNA Influenza Vaccine Priming Effect" J. Infect. Dis. 208: 418-422.

Marasco et al. (2007) "The Growth and Potential of Human Antiviral Monoclonal Antibody Therapeutics," Nature Biotechnology 25:1421-1434.

Okuno et al. (1993) "A Common Neutralizing Epitope Conserved Between the Hemagglutinins of Influenza A Virus H1 and H2 Strain" J. Virol. 67(5):2552-2558.

Padlan et al.(1995) "Identification of Specificity-Determining Residues in Antibodies" FASEB J. 9:133-139.

Pearson (1994) "Using the FASTA Program to Search Protein and DNA Sequence Databases" Methods Mol. Biol. 24:307-331.

Powell et al. (1998) "Compendium of Excipients for Parenteral Formulations" PDA J. Pharm. Sci. & Technol. 52:238-311.

Reddy et al. (2000) "Elimination of Fc Receptor-Dependent Effector Functions of a Modified IgG4 Monoclonal Antibody to Human CD4" J. Immunol. 164:1925-1933.

Reineke (2004) "Antibody Epitope Mapping Using Arrays of Synthetic Peptides" Methods Mol. Biol. 248:443-63.

Shields et al. (2002) "Lack of Fucose on Human IgG1 N-Linked Oligosaccharide Improves Binding to Human Fc RIII and Antibody-dependent Cellular Toxicity" J. Biol. Chem. 277(30):26733-26740.

Sui et al. (2009) "Structural and Functional Bases for Broad-Spectrum Neutralization of Avian and Human Influenza A Viruses" Nat Struct. Mol. Biol. 16(3):265-273.

Throsby et al. (2008) "Heterosubtypic Neutralizing Monoclonal Antibodies Cross-Protective Against H5N1 and H1N1 Recovered From Human IgM+ Memory B Cells" PLOS one 3(12):e3942.

Tomer (2000) "Characterization of a Discontinuous Epitope of the Human Immunodeficiency Virus (HIV) Core Protein p24 by Epitope Excision and Differential Chemical Modification Followed by Mass Spectrometric Peptide Mapping Analysis" Prot. Sci. 9:487-496.

Tutt et al. (1991) "Trispecific F(ab')3 Derivatives That Use Cooperative Signaling Via the TCR/CD3 Complex and CD2 to Activate and Redirect Resting Cytotoxic T Cells" J. Immunol. 147:60-69.

Vajdos et al. (2002) "Comprehensive Functional Maps of the Antigenbinding Site of an Anti-ErbB2 Antibody Obtained withShotgun Scanning Mutagenesis" J. Mol. Biol. 320:415-428.

Nu et al. (1987) "Receptor-mediated in Vitro Gene Transformation by a Soluble DNA Carrier System" J. Biol. Chem. 262:4429-4432.

Dawood et al. (2009) "Influenza A virus (A/California/04/2009(H1N1)) segment 4 hemagglutinin (HA) gene, complete cds" GenBank as accession No. FJ966082.1.

Marasco et al. (2010) "Sequence 62 from Patent WO2010027818" GenBank as accession No. HC483324.1.

Martin et al. (1989) "Modeling Antibody Hypervariable Loops: A Combined Algorithm" Proc. Natl. Acad. Sci. USA 86:9268-9272.

International Search Report and Written Opinion for PCT/US2015/066654 dated Jun. 15, 2016.

Benjamin et al., (2014) "A Broadly Neutralization Human Monoclonal Antibody Directed against a Novel Conserved Epitope on the Influenza Virus H3 Hemagglutinin Globular Head" Journal of Virology, 88(12):6743-6750.

* cited by examiner

Figure 3

```
SEQ ID NO: 18 H1H11729P-HCVR

Gln Val Gln Leu Val Gln Ser Gly Ala Glu Val Lys Lys Ser Gly Ser
Ser Val Lys Val Ser Cys Lys Ala Ser Gly Gly Thr Phe Ser Ser Tyr
Ala Ile Ser Trp Val Arg Gln Ala Pro Gly Gln Gly Leu Glu Trp Met
Gly Gly Ile Ile Pro Ile Phe Gly Thr Pro Ser Tyr Ala Gln Lys Phe
Gln Asp Arg Val Thr Ile Thr Thr Asp Glu Ser Thr Ser Thr Val Tyr
Met Glu Leu Ser Ser Leu Arg Ser Glu Asp Thr Ala Val Tyr Tyr Cys
Ala Arg Gln Gln Pro Val Tyr Gln Tyr Asn Met Asp Val Trp Gly Gln
Gly Thr Thr Val Thr Val Ser Ser
```

```
SEQ ID NO: 20 H1H11729P-HCDR1

Gly Gly Thr Phe Ser Ser Tyr Ala
```

```
SEQ ID NO: 22 H1H11729P-HCDR2

Ile Ile Pro Ile Phe Gly Thr Pro
```

```
SEQ ID NO: 24 H1H11729P-HCDR3

Ala Arg Gln Gln Pro Val Tyr Gln Tyr Asn Met Asp Val
```

```
SEQ ID NO: 26 H1H11729P-LCVR

Asp Ile Gln Met Thr Gln Ser Pro Ser Ser Leu Ser Ala Ser Val Gly
Asp Arg Val Thr Ile Thr Cys Arg Ala Ser Gln Gly Ile Arg Asn Asn
Leu Gly Trp Tyr Gln Gln Lys Pro Leu Lys Ala Pro Lys Arg Leu Ile
Tyr Ala Ala Ser Ser Leu Gln Ser Gly Val Pro Ser Arg Phe Ser Gly
Ser Gly Ser Gly Thr Glu Phe Thr Leu Thr Ile Ser Ser Leu Gln Pro
Glu Asp Phe Ala Thr Tyr Tyr Cys Leu Gln Tyr Asn Asn Tyr Pro Trp
Thr Phe Gly Gly Gly Thr Lys Val Glu Ile Lys
```

```
SEQ ID NO: 28 H1H11729P-LCDR1

Gln Gly Ile Arg Asn Asn
```

```
SEQ ID NO: 30 H1H11729P-LCDR2

Ala Ala Ser
```

```
SEQ ID NO: 32 H1H11729P-LCDR3

Leu Gln Tyr Asn Asn Tyr Pro Trp Thr
```

Figure 4

SEQ ID NO: 50 H1H11829N2-HCVR

Gln Val His Leu Val Gln Ser Gly Pro Glu Val Lys Lys Pro Gly Ser
Ser Val Lys Val Ser Cys Lys Ala Ser Gly Val Thr Phe Ile Ser His
Ala Ile Ser Trp Val Arg Gln Ala Pro Gly Gln Gly Leu Glu Trp Val
Gly Gly Ile Ile Ala Ile Phe Gly Thr Thr Asn Tyr Ala Gln Lys Phe
Gln Gly Arg Val Thr Val Thr Thr Asp Lys Ser Thr Asn Thr Val Tyr
Met Glu Leu Ser Arg Leu Arg Ser Glu Asp Thr Ala Ile Tyr Tyr Cys
Ala Arg Gly Glu Thr Tyr Tyr Glu Gly Asn Phe Asp Phe Trp Gly Gln
Gly Thr Leu Val Thr Val Ser Ser

SEQ ID NO: 52 H1H11829N2-HCDR1

Gly Val Thr Phe Ile Ser His Ala

SEQ ID NO: 54 H1H11829N2-HCDR2

Ile Ile Ala Ile Phe Gly Thr Thr

SEQ ID NO: 56 H1H11829N2-HCDR3

Ala Arg Gly Glu Thr Tyr Tyr Glu Gly Asn Phe Asp Phe

SEQ ID NO: 66 H1H11829N2-LCVR

Asp Ile Gln Met Thr Gln Ser Pro Ser Ser Leu Ser Ala Ser Val Gly
Asp Arg Val Thr Ile Thr Cys Arg Ala Ser Gln Ser Ile Ser Ser Tyr
Leu Asn Trp Tyr Gln Gln Lys Pro Gly Lys Ala Pro Lys Leu Leu Ile
Tyr Ala Ala Ser Ser Leu Gln Ser Gly Val Pro Ser Arg Phe Ser Gly
Ser Gly Ser Gly Thr Asp Phe Thr Leu Thr Ile Ser Ser Leu Gln Pro
Glu Asp Phe Ala Thr Tyr Tyr Cys Gln Gln Ser Tyr Ser Thr Pro Pro
Ile Thr Phe Gly Gln Gly Thr Arg Leu Glu Ile Lys

SEQ ID NO: 68 H1H11829N2-LCDR1

Gln Ser Ile Ser Ser Tyr

SEQ ID NO: 70 H1H11829N2-LCDR2

Ala Ala Ser

SEQ ID NO: 72 H1H11829N2-LCDR3

Gln Gln Ser Tyr Ser Thr Pro Pro Ile Thr

HUMAN ANTIBODIES TO INFLUENZA HEMAGGLUTININ

CROSS-REFERENCE TO RELATED APPLICATIONS

This application claims the benefit under 35 U.S.C § 119(e) of U.S. provisional application Nos. 62/094,752, filed Dec. 19, 2014 and 62/152,122 filed Apr. 24, 2015, both of which are herein specifically incorporated by reference in their entireties.

FIELD OF THE INVENTION

The present invention is related to human antibodies and antigen-binding fragments thereof that specifically bind to influenza hemagglutinin (HA), compositions comprising these antibodies and therapeutic and diagnostic methods of using these antibodies.

SEQUENCE LISTING

An ASCII compliant text file of the sequence listing is filed concurrently with the present specification (37 CFR § 1.52(e) and 37 CFR § 1.821). The contents of the text file are herein incorporated by reference. The text file containing the sequence listing is named "10119US01_seqlisting", was created on Nov. 18, 2015, and contains 2.1 MB.

BACKGROUND OF THE INVENTION

Influenza is a highly contagious disease, which has a long history characterized by waves of pandemics, epidemics, resurgences and outbreaks. In spite of annual vaccination efforts, influenza infections result in substantial morbidity and mortality.

Influenza viruses consist of three types, A, B and C. Furthermore, influenza A viruses can be classified into subtypes based on allelic variations in antigenic regions of two genes that encode the surface glycoproteins, hemagglutinin (HA) and neuraminidase (NA), which are required for viral attachment and entry into the host cell.

Hemagglutinin is a trimeric glycoprotein that contains two structural domains, a globular head domain that consists of the receptor-binding site (that is subject to frequent antigenic drift) and the stem region (more conserved among various strains of influenza virus). The HA protein is synthesized as a precursor (HA0), which undergoes proteolytic processing to produce two subunits (HA1 and HA2), which associate with one another to form the stem/globular head structure. The HA1 peptide is responsible for the attachment of virus to the cell surface. The HA2 peptide forms a stem-like structure that mediates the fusion of viral and cell membranes in endosomes, allowing the release of the ribonucleoprotein complex into the cytoplasm.

Currently, there are eighteen subtypes defined by their hemagglutinin proteins (H1-H18). The 18 HAs can be classified into two groups. Group 1 consists of H1, H2, H5, H6, H8, H9, H11, H12, H13, H16, H17 and H18 subtypes, and group 2 includes H3, H4, H7, H10, H14 and H15 subtypes.

New strains of the same subtype may arise as a result of a phenomenon called antigenic drift, or mutations in the HA or NA molecules which generate new and different epitopes. A consequence of this is that a new vaccine must be produced every year against viruses that are predicted to emerge, a process that is not only costly, but highly inefficient. While technological advances have improved the ability to produce improved influenza antigen(s) for vaccine compositions, there remains a need to provide additional sources of protection to address emerging subtypes and strains of influenza.

While the idea of a vaccine composition comprising the antigen of interest (e.g. the HA and/or NA) to generate broadly neutralizing antibodies in a patient is generally thought to be a good approach, it is not always desirable to use this approach in certain patient populations. For example, in certain patients, a vaccine composition comprising the antigen of interest may not always be effective, such as in the elderly, in the very young, in immunocompromised patients, etc. In these patient populations, or in any patient who is not able to mount an effective immune response, it may be more beneficial to provide a composition already containing broadly neutralizing antibodies that may target epitopes common to a variety of strains within Group 1 and/or Group 2 subtypes.

To date there has been limited success in identifying such antibodies that broadly neutralize or inhibit influenza viruses. Okuno et al. immunized mice with influenza A/Okuda/57 (H2N2) and isolated an antibody designated C179, which bound to a conserved conformational epitope in HA2 and neutralized the Group 1 H2, H1 and H5 subtype influenza A viruses in vitro and in vivo (Okuno et al. (1993) J. Virol. 67(5):2552-2558). Throsby et al. identified 13 monoclonal antibodies from human B cells that had broad activity against Group 1 subtypes (Throsby et al. (2008), PLOS one 3(2):e3942). Sui et al. identified a human monoclonal antibody (F10), which bound H5 and other Group 1 viruses (Sui, et al. (2009), Nat. Struct. Mol. Biol. 16(3):265-273).

However, after decades of research in this area, only a few antibodies are currently in clinical trials to assess their ability to neutralize influenza viruses of different subtypes (See, for example, antibodies under development by Crucell Holland ((US2012/0276115, US2014/0065156, U.S. Pat. No. 8,470,327, US2014/0120113, EP2731967, U.S. Pat. No. 8,691,223, US2013/0243792, US2014/0065165, WO2008/028946 and WO2010/130636); Osaka University (US2011/0319600, EP2380976, US2012/0058124, US2012/0058124), Celltrion (US2013/0004505, EP2545074; WO2014/158001); Vanderbilt University (US2013/0289246), SeaLane Biotechnologies (US2012/0128671), Trellis Bioscience, Inc. (US2012/0020971 EP2582721); Visterra, Inc. (US2013/0302349); Burnham Institute/Dana Farber (US2014/011982, EP2222701, WO2010/027818); Temasek (U.S. Pat. No. 8,444,986, U.S. Pat. No. 8,574,581, U.S. Pat. No. 8,637,644, U.S. Pat. No. 8,637,645, U.S. Pat. No. 8,383,121, U.S. Pat. No. 8,540,996, U.S. Pat. No. 8,574,830, U.S. Pat. No. 8,540,995); HUMABS Biosciences/Institute for Research in Biomedicine (U.S. Pat. No. 8,871,207); MedImmune (WO2015/051010); and Genentech (US2014/0161822), but there are still no marketed antibodies that broadly neutralize or inhibit influenza A virus infection or attenuate the disease caused by various subtypes of this virus. Accordingly, there is still a need in the art to identify new antibodies that neutralize multiple subtypes of influenza A virus, which can be used to prevent or treat an influenza virus infection.

BRIEF SUMMARY OF THE INVENTION

The present invention provides antibodies and antigen-binding fragments thereof that bind influenza hemagglutinin (HA). The antibodies of the present invention are useful, inter alia, for inhibiting or neutralizing the activity of influenza HA. In some embodiments, the antibodies are useful for blocking attachment of the influenza virus to the host cell and/or for preventing the entry of the influenza virus into host cells. In some embodiments, the antibodies function by inhibiting the cell-to-cell transmission of the virus. In certain embodiments, the antibodies are useful in preventing, treating or ameliorating at least one symptom of influenza virus infection in a subject. In certain embodiments, the antibodies may be administered prophylactically or therapeutically to a subject having, or at risk of acquiring, an influenza virus infection. In certain embodiments, compositions containing at least one antibody of the invention may be administered to a subject for whom a vaccine is contra-indicated, or for whom a vaccine is less efficacious, for example, an elderly patient, a very young patient, a patient who may be allergic to any one or more components of a vaccine, or an immunocompromised patient who may be non-responsive to the immunogens in a vaccine. In certain embodiments, compositions containing at least one antibody of the invention may be administered to medical staff, hospitalized patients or nursing home residents or other high-risk patients during an influenza outbreak. In certain embodiments, compositions containing at least one antibody of the invention may be administered as a first line treatment to patients in the event that a predicted yearly vaccine is ineffective, or in the event of a pandemic with a strain that has undergone a major antigenic shift.

The antibodies of the invention can be full-length (for example, an IgG1 or IgG4 antibody) or may comprise only an antigen-binding portion (for example, a Fab, F(ab')$_2$ or scFv fragment), and may be modified to affect functionality, e.g., to increase persistence in the host or to increase effector function or eliminate residual effector functions (Reddy et al., 2000, J. Immunol. 164:1925-1933). In certain embodiments, the antibodies may be bispecific.

In a first aspect, the present invention provides isolated recombinant monoclonal antibodies or antigen-binding fragments thereof that bind specifically to the influenza HA.

In one embodiment, the present invention provides an isolated recombinant antibody or antigen-binding fragment thereof that specifically binds to influenza A hemagglutinin (HA), wherein the antibody has two or more of the following characteristics:

(a) is a fully human monoclonal antibody;
(b) binds to influenza HA with a dissociation constant ($K_D$) of less than $10^{-9}$M, as measured in a real-time biolayer interferometer based biosensor (Octet HTX assay);
(c) demonstrates a dissociative half-life (t½) greater than 370 minutes;
(d) demonstrates neutralization of group 1 influenza A viruses selected from H1N1, H5N1, H9N2, H13N6 and H16N3, with an IC$_{50}$ of less than 130 nM;
(e) demonstrates complement mediated lysis of influenza virus infected cells with an EC$_{50}$ of less than 66 nM;
(f) demonstrates protection, as measured by increased survival in an animal model of influenza virus infection when administered either before or after virus challenge; or
(g) wherein the antibody or antigen-binding fragment thereof comprises three heavy chain complementarity determining regions (CDRs) (HCDR1, HCDR2 and HCDR3) contained within any one of the heavy chain variable region (HCVR) sequences listed in Table 1 or Table 12; and three light chain CDRs (LCDR1, LCDR2 and LCDR3) contained within any one of the light chain variable region (LCVR) sequences listed in Table 1 or Table 12.

In one embodiment, an antibody of the invention demonstrates a dissociative half-life in monkeys that is about 1.5 fold greater than a comparator antibody designated Control I mAb and a dissociative half-life in mice that is about 2 fold greater than the Control I mAb.

In certain embodiments, an antibody of the invention demonstrates an increase in protection as compared to oseltamivir, when administered at 48 hours post infection, or at 72 hours post infection to a mammal infected with influenza virus.

In a related embodiment, an antibody of the invention confers an increase in protection in a mammal infected with influenza virus when administered either subcutaneously or intravenously and/or when administered prior to infection, or after infection with influenza virus.

In one embodiment, an antibody of the invention demonstrates an increase in protection, as compared to an animal administered an isotype (negative) control antibody, when administered to an infected mammal as a single subcutaneous or intravenous dose ranging from about 0.01 mg/kg to about 50 mg/kg.

In one embodiment, an antibody of the invention demonstrates an increase in protection when administered to an influenza virus infected mammal as a single intravenous dose of about 15 mg/kg compared to oral administration of oseltamivir administered twice daily for 5 days at a dose of about 5 mg/kg to about 25 mg/kg.

In one embodiment, an antibody of the invention demonstrates a survival rate of greater than about 20% in a mammal infected with influenza virus, when administered prophylactically as a single subcutaneous dose ranging from about 0.01 mg/kg to about 2 mg/kg.

In one embodiment, an antibody of the invention demonstrates a survival rate of greater than about 30% in a mammal infected with influenza virus, when administered as a single intravenous dose ranging from about 7 mg/kg to about 50 mg/kg by at least 24 hours post infection.

In one embodiment, an antibody of the invention demonstrates a survival rate of about 30% to about 60% in a mammal infected with influenza virus, when administered as a single intravenous dose of about 7 mg/kg to about 50 mg/kg when administered at 48 hours post infection.

In one embodiment, an antibody of the invention demonstrates a survival rate of equal to, or greater than about 60% in a mammal infected with influenza virus, when administered as a single intravenous dose of about 15 mg/kg to about 30 mg/kg at 48 hours or longer post infection.

In one embodiment, an antibody of the invention demonstrates a survival rate of about 100% in a mammal infected with influenza virus, when administered as a single intravenous dose of about 15 mg/kg at 48 hours or longer post infection.

In one embodiment, an antibody of the invention demonstrates a survival rate of about 100% in a mammal infected with influenza virus, when administered as a single intravenous dose of about 15 mg/kg compared to a 40% survival rate observed with oseltamivir when administered orally twice a day for 5 days at a dose of about 25 mg/kg.

In one embodiment, an antibody of the invention provides an additive protective effect in a mammal infected with influenza virus when administered with oseltamivir at greater than 48 hours post infection.

In one embodiment, an antibody of the invention provides an additive protective effect in a mammal infected with influenza virus when administered with oseltamivir at 72 hours post infection.

In one embodiment, an antibody of the invention provides an additive protective effect when used in combination with oseltamivir when the antibody is administered to an influenza virus infected mammal as a single intravenous dose ranging from about 7 mg/kg to about 15 mg/kg and the oseltamivir is administered orally twice daily for 5 days at a dose of about 25 mg/kg.

In a related embodiment, an antibody of the invention provides an additive protective effect when used in combination with oseltamivir at 72 hours after influenza virus infection, wherein the antibody is administered as a single intravenous dose ranging from about 7 mg/kg to about 15 mg/kg and the oseltamivir is administered orally twice daily for 5 days at a dose of about 25 mg/kg.

In one embodiment, an antibody of the invention may be administered intravenously, intranasally, subcutaneously, intradermally, or intramuscularly and the oseltamivir may be administered orally.

In one embodiment, the oseltamivir is administered prior to, concurrently with, or after administration of an antibody of the invention.

In one embodiment, the antibody and/or the oseltamivir may be administered as a single dose, or as multiple doses.

Exemplary anti-influenza HA antibodies of the present invention are listed in Tables 1 and 2 herein. Table 1 sets forth the amino acid sequence identifiers of the heavy chain variable regions (HCVRs), light chain variable regions (LCVRs), heavy chain complementarity determining regions (HCDR1, HCDR2 and HCDR3), and light chain complementarity determining regions (LCDR1, LCDR2 and LCDR3) of exemplary anti-influenza HA antibodies. Table 2 sets forth the nucleic acid sequence identifiers of the HCVRs, LCVRs, HCDR1, HCDR2 HCDR3, LCDR1, LCDR2 and LCDR3 of the exemplary anti-influenza HA antibodies.

Further exemplary anti-influenza HA antibodies of the present invention are listed in Tables 12 and 13 herein. Table 12 sets forth the amino acid sequence identifiers of the heavy chain variable regions (HCVRs), light chain variable regions (LCVRs), heavy chain complementarity determining regions (HCDR1, HCDR2 and HCDR3), and light chain complementarity determining regions (LCDR1, LCDR2 and LCDR3) of exemplary anti-influenza HA antibodies. Table 13 sets forth the nucleic acid sequence identifiers of the HCVRs, LCVRs, HCDR1, HCDR2 HCDR3, LCDR1, LCDR2 and LCDR3 of the exemplary anti-influenza HA antibodies.

The present invention provides antibodies, or antigen-binding fragments thereof, comprising an HCVR comprising an amino acid sequence selected from any of the HCVR amino acid sequences listed in Table 1, or Table 12, or a substantially similar sequence thereof having at least 90%, at least 95%, at least 98% or at least 99% sequence identity thereto.

In one embodiment the invention provides antibodies, or antigen-binding fragments thereof, which specifically bind influenza HA, comprising a HCVR having an amino acid sequence selected from the group consisting of SEQ ID NOs: 2, 18, 34, 50, 74, 90, 106, 122, 138, 154, 170, 186, 202, 218, 234, 242, 250, 258, 266, 274, 282 and 290.

The present invention also provides antibodies, or antigen-binding fragments thereof, comprising an LCVR comprising an amino acid sequence selected from any of the LCVR amino acid sequences listed in Table 1, or Table 12, or a substantially similar sequence thereof having at least 90%, at least 95%, at least 98% or at least 99% sequence identity thereto.

In one embodiment the invention provides antibodies, or antigen-binding fragments thereof, which specifically bind influenza HA, comprising a LCVR having an amino acid sequence selected from the group consisting of SEQ ID NOs: 10, 26, 42, 58, 66, 82, 98, 114, 130, 146, 162, 178, 194, 210 and 226.

The present invention also provides antibodies, or antigen-binding fragments thereof, comprising an HCVR and an LCVR amino acid sequence pair (HCVR/LCVR) comprising any of the HCVR amino acid sequences listed in Table 1, or Table 12 paired with any of the LCVR amino acid sequences listed in Table 1, or Table 12. According to certain embodiments, the present invention provides antibodies, or antigen-binding fragments thereof, comprising an HCVR/LCVR amino acid sequence pair contained within any of the exemplary anti-influenza HA antibodies listed in Table 1, or Table 12.

In one embodiment, the isolated antibody or antigen-binding fragment that specifically binds influenza HA comprises a HCVR/LCVR amino acid sequence pair selected from the group consisting of SEQ ID NOs: 2/10, 18/26, 34/42, 50/58, 50/66, 74/82, 74/66, 90/98, 106/114, 122/130, 138/146, 154/162, 170/178, 186/194, 202/210, 218/226, 234/66, 242/66, 250/66, 258/66, 266/66, 274/66, 282/66 and 290/66.

In certain embodiments, the HCVR/LCVR amino acid sequence pair is selected from the group consisting of SEQ ID NOs: 18/26 (e.g., H1H11729P), 50/58 (e.g., H1H11829N), 50/66 (e.g. H1H11829N2), or 106/114 (e.g., H1H14571N).

In one embodiment, the isolated antibody or antigen-binding fragment comprises:
(a) a HCDR1 domain having an amino acid sequence selected from the group consisting of SEQ ID NOs: 4, 20, 36, 52, 76, 92, 108, 124, 140, 156, 172, 188, 204, 220, 236, 244, 252, 260, 268, 276, 284, and 292;
(b) a HCDR2 domain having an amino acid sequence selected from the group consisting of SEQ ID NOs: 6, 22, 38, 54, 78, 94, 110, 126, 142, 158, 174, 190, 206, 222, 238, 246, 254, 262, 270, 278, 286, and 294;
(c) a HCDR3 domain having an amino acid sequence selected from the group consisting of SEQ ID NOs: 8, 24, 40, 56, 80, 96, 112, 128, 144, 160, 176, 192, 208, 224, 240, 248, 256, 264, 272, 280, 288, and 296;
(d) a LCDR1 domain having an amino acid sequence selected from the group consisting of SEQ ID NOs: 12, 28, 44, 60, 68, 84, 100, 116, 132, 148, 164, 180, 196, 212, and 228;
(e) a LCDR2 domain having an amino acid sequence selected from the group consisting of SEQ ID NOs: 14, 30, 46, 62, 70, 86, 102, 118, 134, 150, 166, 182, 198, 214, and 230; and
(f) a LCDR3 domain having an amino acid sequence selected from the group consisting of SEQ ID NOs: 16, 32, 48, 64, 72, 88, 104, 120, 136, 152, 168, 184, 200, 216 and 232.

In one embodiment, the isolated antibody or antigen-binding fragment, which specifically binds influenza HA, comprises (a) a HCDR1 of SEQ ID NO: 20, (b) a HCDR2 of SEQ ID NO: 22; (c) a HCDR3 of SEQ ID NO: 24; (d) a LCDR1 of SEQ ID NO: 28; (e) a LCDR2 of SEQ ID NO: 30 and (f) a LCDR3 of SEQ ID NO: 32.

In one embodiment, the isolated antibody or antigen-binding fragment, which specifically binds influenza HA, comprises (a) a HCDR1 of SEQ ID NO: 52, (b) a HCDR2 of SEQ ID NO: 54; (c) a HCDR3 of SEQ ID NO: 56; (d) a LCDR1 of SEQ ID NO: 68; (e) a LCDR2 of SEQ ID NO: 70 and (f) a LCDR3 of SEQ ID NO: 72.

In one embodiment, the isolated antibody or antigen-binding fragment, which specifically binds influenza HA, comprises (a) a HCDR1 of SEQ ID NO: 52, (b) a HCDR2 of SEQ ID NO: 54; (c) a HCDR3 of SEQ ID NO: 56; (d) a LCDR1 of SEQ ID NO: 60; (e) a LCDR2 of SEQ ID NO: 62 and (f) a LCDR3 of SEQ ID NO: 64.

In one embodiment, the isolated antibody or antigen-binding fragment, which specifically binds influenza HA, comprises (a) a HCDR1 of SEQ ID NO: 108, (b) a HCDR2 of SEQ ID NO: 110; (c) a HCDR3 of SEQ ID NO: 112; (d) a LCDR1 of SEQ ID NO: 116; (e) a LCDR2 of SEQ ID NO: 118 and (f) a LCDR3 of SEQ ID NO: 120.

The present invention also provides antibodies, or antigen-binding fragments thereof, comprising a heavy chain CDR1 (HCDR1) comprising an amino acid sequence selected from any of the HCDR1 amino acid sequences listed in Table 1, or Table 12, or a substantially similar sequence thereof having at least 90%, at least 95%, at least 98% or at least 99% sequence identity.

The present invention also provides antibodies, or antigen-binding fragments thereof, comprising a heavy chain CDR2 (HCDR2) comprising an amino acid sequence selected from any of the HCDR2 amino acid sequences listed in Table 1, or Table 12, or a substantially similar sequence thereof having at least 90%, at least 95%, at least 98% or at least 99% sequence identity.

The present invention also provides antibodies, or antigen-binding fragments thereof, comprising a heavy chain CDR3 (HCDR3) comprising an amino acid sequence selected from any of the HCDR3 amino acid sequences listed in Table 1, or Table 12, or a substantially similar sequence thereof having at least 90%, at least 95%, at least 98% or at least 99% sequence identity.

The present invention also provides antibodies, or antigen-binding fragments thereof, comprising a light chain CDR1 (LCDR1) comprising an amino acid sequence selected from any of the LCDR1 amino acid sequences listed in Table 1, or Table 12, or a substantially similar sequence thereof having at least 90%, at least 95%, at least 98% or at least 99% sequence identity.

The present invention also provides antibodies, or antigen-binding fragments thereof, comprising a light chain CDR2 (LCDR2) comprising an amino acid sequence selected from any of the LCDR2 amino acid sequences listed in Table 1, or Table 12, or a substantially similar sequence thereof having at least 90%, at least 95%, at least 98% or at least 99% sequence identity.

The present invention also provides antibodies, or antigen-binding fragments thereof, comprising a light chain CDR3 (LCDR3) comprising an amino acid sequence selected from any of the LCDR3 amino acid sequences listed in Table 1, or Table 12, or a substantially similar sequence thereof having at least 90%, at least 95%, at least 98% or at least 99% sequence identity.

The present invention also provides antibodies, or antigen-binding fragments thereof, comprising an HCDR3 and an LCDR3 amino acid sequence pair (HCDR3/LCDR3) comprising any of the HCDR3 amino acid sequences listed in Table 1, or Table 12, paired with any of the LCDR3 amino acid sequences listed in Table 1, or Table 12. According to certain embodiments, the present invention provides antibodies, or antigen-binding fragments thereof, comprising an HCDR3/LCDR3 amino acid sequence pair contained within any of the exemplary anti-influenza HA antibodies listed in Table 1, or Table 12. In certain embodiments, the HCDR3/LCDR3 amino acid sequence pair is selected from the group consisting of SEQ ID NOs: 24/32 (e.g., H1H11729P), 56/64 (e.g., H1H11829N), 56/72 (e.g. H1H11829N2) and 112/120 (e.g., H1H14571N).

The present invention also provides antibodies, or antigen-binding fragments thereof, comprising a set of six CDRs (i.e., HCDR1-HCDR2-HCDR3-LCDR1-LCDR2-LCDR3) contained within any of the exemplary anti-influenza HA antibodies listed in Table 1, or Table 12. In certain embodiments, the HCDR1-HCDR2-HCDR3-LCDR1-LCDR2-LCDR3 amino acid sequence set is selected from the group consisting of SEQ ID NOs: 20-22-24-28-30-32 (e.g., H1H11729P), 52-54-56-60-62-64 (e.g., H1H11829N); 52-54-56-68-70-72 (e.g. H1H11829N2) and 108-110-112-116-118 and 120 (e.g., H1H14571N).

In a related embodiment, the present invention provides antibodies, or antigen-binding fragments thereof, comprising a set of six CDRs (i.e., HCDR1-HCDR2-HCDR3-LCDR1-LCDR2-LCDR3) contained within an HCVR/LCVR amino acid sequence pair as defined by any of the exemplary anti-influenza HA antibodies listed in Table 1, or Table 12. For example, the present invention includes antibodies, or antigen-binding fragments thereof, comprising the HCDR1-HCDR2-HCDR3-LCDR1-LCDR2-LCDR3 amino acid sequences set contained within an HCVR/LCVR amino acid sequence pair selected from the group consisting of SEQ ID NOs: 18/26 (e.g., H1H11729P), 50/58 (e.g., H1H11829N), 50/66 (e.g. H1H11829N2) and 106/114 (e.g., H1H14571N). Methods and techniques for identifying CDRs within HCVR and LCVR amino acid sequences are well known in the art and can be used to identify CDRs within the specified HCVR and/or LCVR amino acid sequences disclosed herein. Exemplary conventions that can be used to identify the boundaries of CDRs include, e.g., the Kabat definition, the Chothia definition, and the AbM definition. In general terms, the Kabat definition is based on sequence variability, the Chothia definition is based on the location of the structural loop regions, and the AbM definition is a compromise between the Kabat and Chothia approaches. See, e.g., Kabat, "Sequences of Proteins of Immunological Interest," National Institutes of Health, Bethesda, Md. (1991); Al-Lazikani et al., *J. Mol. Biol.* 273:927-948 (1997); and Martin et al., *Proc. Natl. Acad. Sci. USA* 86:9268-9272 (1989). Public databases are also available for identifying CDR sequences within an antibody.

The present invention includes anti-influenza HA antibodies having a modified glycosylation pattern. In some embodiments, modification to remove undesirable glycosylation sites may be useful, or an antibody lacking a fucose moiety present on the oligosaccharide chain, for example, to increase antibody dependent cellular cytotoxicity (ADCC) function (see Shield et al. (2002) JBC 277:26733). In other applications, modification of galactosylation can be made in order to modify complement dependent cytotoxicity (CDC).

The present invention also provides for antibodies and antigen-binding fragments thereof that compete for specific binding to influenza HA with an antibody or antigen-binding fragment thereof comprising the CDRs of a HCVR and the CDRs of a LCVR, wherein the HCVR and LCVR each has an amino acid sequence selected from the HCVR and LCVR sequences listed in Table 1, or Table 12.

The present invention also provides antibodies and antigen-binding fragments thereof that cross-compete for binding to influenza HA, or that bind the same epitope on influenza HA, as a reference antibody or antigen-binding fragment thereof comprising the CDRs of a HCVR and the CDRs of a LCVR, wherein the HCVR and LCVR each has an amino acid sequence selected from the HCVR and LCVR sequences listed in Table 1, or Table 12.

The present invention also provides isolated antibodies and antigen-binding fragments thereof that block influenza HA attachment to, and/or entry into a host cell.

In certain embodiments, the antibodies or antigen-binding fragments of the present invention are bispecific comprising a first binding specificity to a first epitope in the influenza HA and a second binding specificity to another antigen.

In a second aspect, the present invention provides nucleic acid molecules encoding anti-influenza HA antibodies or portions thereof. For example, the present invention provides nucleic acid molecules encoding any of the HCVR amino acid sequences listed in Table 1, or Table 12; in certain embodiments the nucleic acid molecule comprises a polynucleotide sequence selected from any of the HCVR nucleic acid sequences listed in Table 2, or Table 13, or a substantially similar sequence thereof having at least 90%, at least 95%, at least 98% or at least 99% sequence identity thereto.

The present invention also provides nucleic acid molecules encoding any of the LCVR amino acid sequences listed in Table 1, or Table 12; in certain embodiments the nucleic acid molecule comprises a polynucleotide sequence selected from any of the LCVR nucleic acid sequences listed in Table 2, or Table 13, or a substantially similar sequence thereof having at least 90%, at least 95%, at least 98% or at least 99% sequence identity thereto.

The present invention also provides nucleic acid molecules encoding any of the HCDR1 amino acid sequences listed in Table 1, or Table 12; in certain embodiments the nucleic acid molecule comprises a polynucleotide sequence selected from any of the HCDR1 nucleic acid sequences listed in Table 2, or Table 13, or a substantially similar sequence thereof having at least 90%, at least 95%, at least 98% or at least 99% sequence identity thereto.

The present invention also provides nucleic acid molecules encoding any of the HCDR2 amino acid sequences listed in Table 1, or Table 12; in certain embodiments the nucleic acid molecule comprises a polynucleotide sequence selected from any of the HCDR2 nucleic acid sequences listed in Table 2, or Table 13, or a substantially similar sequence thereof having at least 90%, at least 95%, at least 98% or at least 99% sequence identity thereto.

The present invention also provides nucleic acid molecules encoding any of the HCDR3 amino acid sequences listed in Table 1, or Table 12; in certain embodiments the nucleic acid molecule comprises a polynucleotide sequence selected from any of the HCDR3 nucleic acid sequences listed in Table 2, or Table 13, or a substantially similar sequence thereof having at least 90%, at least 95%, at least 98% or at least 99% sequence identity thereto.

The present invention also provides nucleic acid molecules encoding any of the LCDR1 amino acid sequences listed in Table 1, or Table 12; in certain embodiments the nucleic acid molecule comprises a polynucleotide sequence selected from any of the LCDR1 nucleic acid sequences listed in Table 2, or Table 13, or a substantially similar sequence thereof having at least 90%, at least 95%, at least 98% or at least 99% sequence identity thereto.

The present invention also provides nucleic acid molecules encoding any of the LCDR2 amino acid sequences listed in Table 1, or Table 12; in certain embodiments the nucleic acid molecule comprises a polynucleotide sequence selected from any of the LCDR2 nucleic acid sequences listed in Table 2, or Table 13, or a substantially similar sequence thereof having at least 90%, at least 95%, at least 98% or at least 99% sequence identity thereto.

The present invention also provides nucleic acid molecules encoding any of the LCDR3 amino acid sequences listed in Table 1, or Table 12; in certain embodiments the nucleic acid molecule comprises a polynucleotide sequence selected from any of the LCDR3 nucleic acid sequences listed in Table 2, or Table 13, or a substantially similar sequence thereof having at least 90%, at least 95%, at least 98% or at least 99% sequence identity thereto.

The present invention also provides nucleic acid molecules encoding an HCVR, wherein the HCVR comprises a set of three CDRs (i.e., HCDR1-HCDR2-HCDR3), wherein the HCDR1-HCDR2-HCDR3 amino acid sequence set is as defined by any of the exemplary anti-influenza HA antibodies listed in Table 1, or Table 12.

The present invention also provides nucleic acid molecules encoding an LCVR, wherein the LCVR comprises a set of three CDRs (i.e., LCDR1-LCDR2-LCDR3), wherein the LCDR1-LCDR2-LCDR3 amino acid sequence set is as defined by any of the exemplary anti-influenza HA antibodies listed in Table 1, or Table 12.

The present invention also provides nucleic acid molecules encoding both an HCVR and an LCVR, wherein the HCVR comprises an amino acid sequence of any of the HCVR amino acid sequences listed in Table 1, or Table 12 and wherein the LCVR comprises an amino acid sequence of any of the LCVR amino acid sequences listed in Table 1, or Table 12. In certain embodiments, the nucleic acid molecule comprises a polynucleotide sequence selected from any of the HCVR nucleic acid sequences listed in Table 2, or Table 13, or a substantially similar sequence thereof having at least 90%, at least 95%, at least 98% or at least 99% sequence identity thereto, and a polynucleotide sequence selected from any of the LCVR nucleic acid sequences listed in Table 2, or a substantially similar sequence thereof having at least 90%, at least 95%, at least 98% or at least 99% sequence identity thereto. In certain embodiments according to this aspect of the invention, the nucleic acid molecule encodes an HCVR and LCVR, wherein the HCVR and LCVR are both derived from the same anti-influenza HA antibody listed in Table 1, or Table 12.

The present invention provides nucleic acid molecules encoding any of the heavy chain amino acid sequences listed in Table 1, or Table 12. The present invention also provides nucleic acid molecules encoding any of the light chain amino acid sequences listed in Table 1, or Table 12.

In a related aspect, the present invention provides recombinant expression vectors capable of expressing a polypeptide comprising a heavy or light chain variable region of an anti-influenza HA antibody. For example, the present invention includes recombinant expression vectors comprising any of the nucleic acid molecules mentioned above, i.e., nucleic acid molecules encoding any of the HCVR, LCVR, and/or CDR sequences as set forth in Table 1, or Table 12. Also included within the scope of the present invention are host cells into which such vectors have been introduced, as well as methods of producing the antibodies or portions thereof by culturing the host cells under conditions permitting production of the antibodies or antibody fragments, and recovering the antibodies and antibody fragments so produced.

In a third aspect, the invention provides a pharmaceutical composition comprising a therapeutically effective amount of at least one recombinant monoclonal antibody or antigen-binding fragment thereof which specifically binds influenza HA and a pharmaceutically acceptable carrier. In a related aspect, the invention features a composition, which is a combination of an anti-influenza HA antibody and a second therapeutic agent. In one embodiment, the second therapeutic agent is any agent that is advantageously combined with an anti-influenza HA antibody. Exemplary agents that may be advantageously combined with an anti-influenza HA antibody include, without limitation, other agents that bind and/or inhibit influenza HA activity (including other antibodies or antigen-binding fragments thereof, etc.) and/or agents, which do not directly bind influenza HA but nonetheless inhibit viral activity including infectivity of host cells. In certain embodiments, the invention provides for a pharmaceutical composition comprising: (a) a first anti-influenza HA antibody or antigen-binding fragment thereof; (b) a second anti-influenza HA antibody or antigen-binding fragment thereof, wherein the first antibody binds to a first epitope on influenza HA and the second antibody binds to a second epitope on influenza HA wherein the first and second epitopes are distinct and non-overlapping; and (c) a pharmaceutically acceptable carrier or diluent. In certain embodiments, the invention provides for a pharmaceutical composition comprising: (a) a first anti-influenza HA antibody or antigen-binding fragment thereof; (b) a second anti-influenza HA antibody or antigen-binding fragment thereof, wherein the first antibody does not cross-compete with the second antibody for binding to influenza HA; and (c) a pharmaceutically acceptable carrier or diluent. In certain embodiments, the invention provides for a pharmaceutical composition comprising: (a) a first anti-influenza HA antibody or antigen-binding fragment thereof; (b) a second anti-influenza antibody or antigen-binding fragment thereof, which interacts with a different influenza antigen, wherein the first antibody binds to an epitope on influenza HA and the second antibody binds to an epitope on a different influenza antigen; and (c) a pharmaceutically acceptable carrier or diluent. In certain embodiments, the invention provides for a pharmaceutical composition comprising: (a) a first anti-influenza HA antibody or antigen-binding fragment thereof; (b) a second antibody or antigen-binding fragment thereof, which interacts with a different viral (non-influenza) antigen, wherein the first antibody binds to an epitope on influenza HA and the second antibody binds to an epitope on a different viral (non-influenza) antigen; and (c) a pharmaceutically acceptable carrier or diluent. Additional combination therapies and co-formulations involving the anti-influenza HA antibodies of the present invention are disclosed elsewhere herein.

In a fourth aspect, the invention provides therapeutic methods for treating a disease or disorder associated with influenza HA (such as viral infection in a subject), or at least one symptom associated with the viral infection, using an anti-influenza HA antibody or antigen-binding portion of an antibody of the invention, wherein the therapeutic methods comprise administering a therapeutically effective amount of a pharmaceutical composition comprising an antibody or antigen-binding fragment of an antibody of the invention to the subject in need thereof. The disorder treated is any disease or condition, which is improved, ameliorated, inhibited or prevented by inhibition of influenza HA activity. In certain embodiments, the invention provides methods to prevent, treat or ameliorate at least one symptom of influenza A infection, the method comprising administering a therapeutically effective amount of an anti-influenza HA antibody or antigen-binding fragment thereof of the invention to a subject in need thereof.

In some embodiments, the present invention provides methods to ameliorate or reduce the severity, duration, or frequency of occurrence, of at least one symptom of influenza infection in a subject by administering an anti-influenza HA antibody of the invention, wherein the at least one symptom is selected from the group consisting of headache, fever, aches, rhinorrhea (nasal congestion), chills, fatigue, weakness, sore throat, cough, shortness of breath, vomiting, diarrhea, pneumonia, bronchitis, and death.

In certain embodiments, the invention provides methods to decrease viral load in a subject, the methods comprising administering to the subject an effective amount of an antibody or fragment thereof of the invention that binds influenza HA and blocks influenza HA binding and/or entry into the host cell.

In certain embodiments, the antibody or antigen-binding fragment thereof may be administered prophylactically or therapeutically to a subject having, or at risk of having, or predisposed to developing an influenza infection. The subjects at risk include, but are not limited to, an immunocompromised person, for example, a person who is immunocompromised because of autoimmune disease, or those persons receiving immunosuppressive therapy (for example, following organ transplant), or those persons afflicted with human immunodeficiency syndrome (HIV) or acquired immune deficiency syndrome (AIDS), certain forms of anemia that deplete or destroy white blood cells, those persons receiving radiation or chemotherapy, or those persons afflicted with an inflammatory disorder. Other subjects at risk for acquiring an influenza infection include an elderly adult (more than 65 years of age), children younger than 2 years of age, healthcare workers, and people with underlying medical conditions such as pulmonary infection, heart disease or diabetes. Also, any person who comes into physical contact or close physical proximity with an infected individual has an increased risk of developing an influenza virus infection. Moreover, a subject is at risk of contracting an influenza infection due to proximity to an outbreak of the disease, e.g. subject resides in a densely-populated city or in close proximity to subjects having confirmed or suspected infections of influenza virus, or choice of employment, e.g. hospital worker, pharmaceutical researcher, traveler to infected area, or frequent flier.

In certain embodiments, the antibody or antigen-binding fragment thereof of the invention is administered in combination with a second therapeutic agent to the subject in need thereof. The second therapeutic agent may be selected from the group consisting of an anti-inflammatory drug (such as corticosteroids, and non-steroidal anti-inflammatory drugs), an anti-infective drug, a different antibody to influenza HA, an antibody to a different influenza antigen (e.g. the neuraminidase), an anti-viral drug, a decongestant, an antihistamine, a vaccine for influenza, a dietary supplement such as anti-oxidants and any other drug or therapy known in the art useful for ameliorating at least one symptom of the influenza infection, or for reducing the viral load in a patient. In certain embodiments, the second therapeutic agent may be an agent that helps to counteract or reduce any possible side effect(s) associated with an antibody or antigen-binding fragment thereof of the invention, if such side effect(s) should occur. The antibody or fragment thereof may be administered subcutaneously, intravenously, intradermally, intraperitoneally, orally, intranasally, intramuscularly, or intracranially. In one embodiment, the antibody may be administered as a single intravenous infusion for maximum concentration of the antibody in the serum of the subject. The antibody or fragment thereof may be administered at a dose of about 0.01 mg/kg of body weight to about 100 mg/kg of body weight of the subject. In certain embodiments, an antibody of the present invention may be administered at one or more doses comprising between 50 mg to 5000 mg.

The present invention also includes use of an anti-influenza HA antibody or antigen-binding fragment thereof of the invention for treating a disease or disorder that would benefit from the blockade of influenza HA binding and/or activity. The present invention also includes use of an anti-influenza HA antibody or antigen-binding fragment thereof of the invention in the manufacture of a medicament for the treatment of a disease or disorder that would benefit from the blockade of influenza HA binding and/or activity.

Other embodiments will become apparent from a review of the ensuing detailed description.

BRIEF DESCRIPTION OF THE FIGURES

FIG. 3. Shows the HCVR, HCDR1, HCDR2, HCDR3, LCVR, LCDR1, LCDR2 and LCDR3 sequences for the antibody designated H1H11729P.

FIG. 4. Shows the HCVR, HCDR1, HCDR2, HCDR3, LCVR, LCDR1, LCDR2 and LCDR3 amino acid sequences for the antibody designated H1H11829N2.

DETAILED DESCRIPTION

Figure 1:
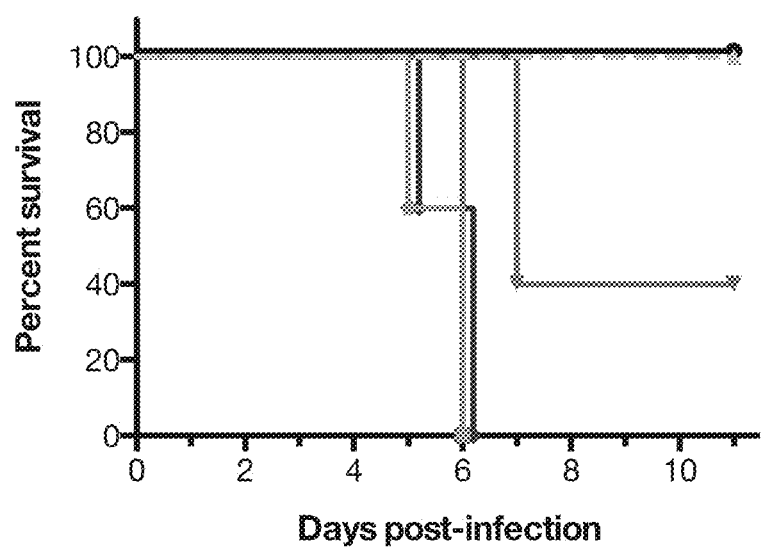
FIG. 1. Shows that a single dose of H1H11729P at 48 hrs post infection demonstrates greater efficacy than oseltamivir at 48 hrs post infection in treating severe influenza A virus infection in mice. A single dose of H1H11729P at 15 mg/kg (circles) given 48 h p.i. is more efficacious than oseltamivir (TAMIFLU®) dosed twice daily (BID) for 5 days starting on day 2 post infection at 25 (inverse triangles) or 5 mg/kg (diamonds). Mice were infected intranasally (IN) on day 0 with 10×MLD$_{50}$ of A/Puerto Rico/08/1934 (H1N1). Control groups included an uninfected (triangles, dotted line) and infected (hexagons) group that received oral gavage of water and CR8020 as an IgG1 isotype (negative) control.

Before the present methods are described, it is to be understood that this invention is not limited to particular methods, and experimental conditions described, as such methods and conditions may vary. It is also to be understood that the terminology used herein is for the purpose of describing particular embodiments only, and is not intended to be limiting, since the scope of the present invention will be limited only by the appended claims.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, preferred methods and materials are now described. All publications mentioned herein are incorporated herein by reference in their entirety.

Definitions

The term "influenza hemagglutinin", also called "influenza HA" is a trimeric glycoprotein found on the surface of influenza virions, which mediates viral attachment (via HA1 binding to α-2,3- and α-2,6-sialic acids) and entry (through conformational change) into host cells. The HA is comprised of two structural domains: a globular head domain containing the receptor binding site (subject to high frequency of antigenic mutations) and the stem region (more conserved among various strains of influenza virus). The influenza HA is synthesized as a precursor (HA0) that undergoes proteolytic processing to produce two subunits (HA1 and HA2) which associate with one another to form the stem/globular head structure. The viral HA is the most variable antigen on the virus (18 subtypes can be classified into two groups), but the stem (HA2) is highly conserved within each group.

The amino acid sequence of full-length Influenza HA is exemplified by the amino acid sequence of influenza isolate H1N1 A/California/04/2009 provided in GenBank as accession number FJ966082.1. The term "influenza-HA" also includes protein variants of influenza HA isolated from different influenza isolates, e.g., GQ149237.1, NC_002017, KM972981.1, etc. The term "influenza-HA" also includes recombinant influenza HA or a fragment thereof. The term also encompasses influenza HA or a fragment thereof coupled to, for example, histidine tag, mouse or human Fc, or a signal sequence.

The term "influenza infection", as used herein, also characterized as "flu" refers to the severe acute respiratory illness caused by influenza virus. The term includes respiratory tract infection and the symptoms that include high fever, headache, general aches and pains, fatigue and weakness, in some instances extreme exhaustion, stuffy nose, sneezing, sore throat, chest discomfort, cough, shortness of breath, bronchitis, pneumonia and death in severe cases.

The term "antibody", as used herein, is intended to refer to immunoglobulin molecules comprised of four polypeptide chains, two heavy (H) chains and two light (L) chains inter-connected by disulfide bonds (i.e., "full antibody molecules"), as well as multimers thereof (e.g. IgM) or antigen-binding fragments thereof. Each heavy chain is comprised of a heavy chain variable region ("HCVR" or "$V_H$") and a heavy chain constant region (comprised of domains $C_H1$, $C_H2$ and $C_H3$). Each light chain is comprised of a light chain variable region ("LCVR or "$V_L$") and a light chain constant region ($C_L$). The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. In certain embodiments of the invention, the FRs of the antibody (or antigen binding fragment thereof) may be identical to the human germline sequences, or may be naturally or artificially modified. An amino acid consensus sequence may be defined based on a side-by-side analysis of two or more CDRs.

Substitution of one or more CDR residues or omission of one or more CDRs is also possible. Antibodies have been described in the scientific literature in which one or two CDRs can be dispensed with for binding. Padlan et al. (1995

FASEB J. 9:133-139) analyzed the contact regions between antibodies and their antigens, based on published crystal structures, and concluded that only about one fifth to one third of CDR residues actually contact the antigen. Padlan also found many antibodies in which one or two CDRs had no amino acids in contact with an antigen (see also, Vajdos et al. 2002 J Mol Biol 320:415-428).

CDR residues not contacting antigen can be identified based on previous studies (for example residues H60-H65 in CDRH2 are often not required), from regions of Kabat CDRs lying outside Chothia CDRs, by molecular modeling and/or empirically. If a CDR or residue(s) thereof is omitted, it is usually substituted with an amino acid occupying the corresponding position in another human antibody sequence or a consensus of such sequences. Positions for substitution within CDRs and amino acids to substitute can also be selected empirically. Empirical substitutions can be conservative or non-conservative substitutions.

The fully human anti-influenza-HA monoclonal antibodies disclosed herein may comprise one or more amino acid substitutions, insertions and/or deletions in the framework and/or CDR regions of the heavy and light chain variable domains as compared to the corresponding germline sequences. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired properties such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

The present invention also includes fully human anti-influenza-HA monoclonal antibodies comprising variants of any of the HCVR, LCVR, and/or CDR amino acid sequences disclosed herein having one or more conservative substitutions. For example, the present invention includes anti-influenza-HA antibodies having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences disclosed herein.

The term "human antibody", as used herein, is intended to include antibodies having variable and constant regions derived from human germline immunoglobulin sequences. The human mAbs of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include mAbs in which CDR sequences derived from the germline of another mammalian species (e.g., mouse), have been grafted onto human FR sequences. The term includes antibodies recombinantly produced in a non-human mammal, or in cells of a non-human mammal. The term is not intended to include antibodies isolated from or generated in a human subject.

The term "recombinant", as used herein, refers to antibodies or antigen-binding fragments thereof of the invention created, expressed, isolated or obtained by technologies or methods known in the art as recombinant DNA technology which include, e.g., DNA splicing and transgenic expression. The term refers to antibodies expressed in a non-human mammal (including transgenic non-human mammals, e.g., transgenic mice), or a cell (e.g., CHO cells) expression system or isolated from a recombinant combinatorial human antibody library.

The term "specifically binds," or "binds specifically to", or the like, means that an antibody or antigen-binding fragment thereof forms a complex with an antigen that is relatively stable under physiologic conditions. Specific binding can be characterized by an equilibrium dissociation constant of at least about $1\times10^{-8}$ M or less (e.g., a smaller $K_D$ denotes a tighter binding). Methods for determining whether two molecules specifically bind are well known in the art and include, for example, equilibrium dialysis, surface plasmon resonance, and the like. As described herein, antibodies have been identified by real-time, label free bio-layer interferometry assay on an Octet® HTX biosensor, which bind specifically to influenza-HA. Moreover, multi-specific antibodies that bind to one domain in influenza-HA and one or more additional antigens or a bi-specific that binds to two different regions of influenza-HA are nonetheless considered antibodies that "specifically bind", as used herein.

The term "high affinity" antibody refers to those mAbs having a binding affinity to influenza-HA, expressed as $K_D$, of at least $10^{-8}$ M; preferably $10^{-9}$ M; more preferably $10^{-10}$ M, even more preferably $10^{-11}$ M, even more preferably $10^{-12}$ M, as measured by real-time, label free bio-layer interferometry assay, e.g., an Octet® HTX biosensor, or by surface plasmon resonance, e.g., BIACORE™, or by solution-affinity ELISA.

By the term "slow off rate", "Koff" or "kd" is meant an antibody that dissociates from influenza-HA, with a rate constant of $1\times10^{-3}$ s$^{-1}$ or less, preferably $1\times10^{-4}$ s$^{-1}$ or less, as determined by real-time, label free bio-layer interferometry assay, e.g., an Octet® HTX biosensor, or by surface plasmon resonance, e.g., BIACORE™.

The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. The terms "antigen-binding fragment" of an antibody, or "antibody fragment", as used herein, refers to one or more fragments of an antibody that retain the ability to bind to Influenza HA.

In specific embodiments, antibody or antibody fragments of the invention may be conjugated to a moiety such a ligand or a therapeutic moiety ("immunoconjugate"), such as an anti-viral drug, a second anti-influenza antibody, or any other therapeutic moiety useful for treating an infection caused by influenza-HA.

An "isolated antibody", as used herein, is intended to refer to an antibody that is substantially free of other antibodies (Abs) having different antigenic specificities (e.g., an isolated antibody that specifically binds influenza-HA, or a fragment thereof, is substantially free of Abs that specifically bind antigens other than influenza-HA.

A "blocking antibody" or a "neutralizing antibody", as used herein (or an "antibody that neutralizes influenza-HA activity" or "antagonist antibody"), is intended to refer to an antibody whose binding to influenza-HA results in inhibition of at least one biological activity of influenza-HA. For example, an antibody of the invention may prevent or block influenza attachment to, or entry into a host cell. In addition, a "neutralizing antibody" is one that can neutralize, i.e., prevent, inhibit, reduce, impede or interfere with, the ability of a pathogen to initiate and/or perpetuate an infection in a host. The terms "neutralizing antibody" and "an antibody that neutralizes" or "antibodies that neutralize" are used interchangeably herein. These antibodies can be used, alone or in combination, as prophylactic or therapeutic agents with other anti-viral agents upon appropriate formulation, or in association with active vaccination, or as a diagnostic tool.

The term "surface plasmon resonance", refers to an optical phenomenon that allows for the analysis of real-time biomolecular interactions by detection of alterations in protein concentrations within a biosensor matrix, for example using the BIACORE™ system (Pharmacia Biosensor AB, Uppsala, Sweden and Piscataway, N.J.

Bio-layer interferometry is a label-free technology for measuring biomolecular interactions. It is an optical analytical technique that analyzes the interference pattern of white light reflected from two surfaces: a layer of immobilized protein on the biosensor tip, and an internal reference layer. Any change in the number of molecules bound to the biosensor tip causes a shift in the interference pattern that can be measured in real-time (Abdiche, Y. N., et al. Analytical Biochemistry, (2008), 377(2), 209-217). In certain embodiments of the invention, a "real-time bio-layer interferometer based biosensor (Octet HTX assay)" was used to assess the binding characteristics of certain of the anti-influenza HA antibodies.

The term "$K_D$", as used herein, is intended to refer to the equilibrium dissociation constant of a particular antibody-antigen interaction.

The term "epitope" refers to an antigenic determinant that interacts with a specific antigen-binding site in the variable region of an antibody molecule known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

The term "cross-competes", as used herein, means an antibody or antigen-binding fragment thereof binds to an antigen and inhibits or blocks the binding of another antibody or antigen-binding fragment thereof. The term also includes competition between two antibodies in both orientations, i.e., a first antibody that binds and blocks binding of second antibody and vice-versa. In certain embodiments, the first antibody and second antibody may bind to the same epitope. Alternatively, the first and second antibodies may bind to different, but overlapping epitopes such that binding of one inhibits or blocks the binding of the second antibody, e.g., via steric hindrance. Cross-competition between antibodies may be measured by methods known in the art, for example, by a real-time, label-free bio-layer interferometry assay. Cross-competition between two antibodies may be expressed as the binding of the second antibody that is less than the background signal due to self-self binding (wherein first and second antibodies is the same antibody). Cross-competition between 2 antibodies may be expressed, for example, as % binding of the second antibody that is less than the baseline self-self background binding (wherein first and second antibodies is the same antibody).

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 90%, and more preferably at least about 95%, 96%, 97%, 98% or 99% of the nucleotide bases, as measured by any well-known algorithm of sequence identity, such as FASTA, BLAST or GAP, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs GAP or BESTFIT using default gap weights, share at least 90% sequence identity, even more preferably at least 95%, 98% or 99% sequence identity. Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. See, e.g., Pearson (1994) Methods Mol. Biol. 24: 307-331, which is herein incorporated by reference. Examples of groups of amino acids that have side chains with similar chemical properties include 1) aliphatic side chains: glycine, alanine, valine, leucine and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45, herein incorporated by reference. A "moderately conservative" replacement is any change having a nonnegative value in the PAM250 log-likelihood matrix.

Sequence similarity for polypeptides is typically measured using sequence analysis software. Protein analysis software matches similar sequences using measures of similarity assigned to various substitutions, deletions and other modifications, including conservative amino acid substitutions. For instance, GCG software contains programs such as GAP and BESTFIT which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215: 403-410 and (1997) Nucleic Acids Res. 25:3389-3402, each of which is herein incorporated by reference.

By the phrase "therapeutically effective amount" is meant an amount that produces the desired effect for which it is administered. The exact amount will depend on the purpose of the treatment, and will be ascertainable by one skilled in the art using known techniques (see, for example, Lloyd (1999) The Art, Science and Technology of Pharmaceutical Compounding).

As used herein, the term "subject" refers to an animal, preferably a mammal, more preferably a human, in need of amelioration, prevention and/or treatment of a disease or disorder such as viral infection. The subject may have an influenza infection or is predisposed to developing an influenza virus infection. Subjects "predisposed to developing an influenza virus infection", or subjects "who may be at elevated risk for contracting an influenza virus infection", are those subjects with compromised immune systems because of autoimmune disease, those persons receiving immunosuppressive therapy (for example, following organ transplant), those persons afflicted with human immunodeficiency syndrome (HIV) or acquired immune deficiency syndrome (AIDS), certain forms of anemia that deplete or destroy white blood cells, those persons receiving radiation or chemotherapy, or those persons afflicted with an inflammatory disorder. Additionally, subject of extreme young or old age are at increased risk. Any person who comes into physical contact or close physical proximity with an infected individual has an increased risk of developing an Influenza virus infection. Moreover, a subject is at risk of contracting an influenza infection due to proximity to an outbreak of the disease, e.g. subject resides in a densely-populated city or in close proximity to subjects having confirmed or suspected infections of Influenza virus, or choice of employment, e.g. hospital worker, pharmaceutical researcher, traveler to infected area, or frequent flier.

As used herein, the terms "treat", "treating", or "treatment" refer to the reduction or amelioration of the severity of at least one symptom or indication of influenza infection due to the administration of a therapeutic agent such as an antibody of the present invention to a subject in need thereof. The terms include inhibition of progression of disease or of worsening of infection. The terms also include positive prognosis of disease, i.e., the subject may be free of infection or may have reduced or no viral titers upon administration of a therapeutic agent such as an antibody of the present invention. The therapeutic agent may be administered at a therapeutic dose to the subject.

The terms "prevent", "preventing" or "prevention" refer to inhibition of manifestation of influenza infection or any symptoms or indications of influenza infection upon administration of an antibody of the present invention. The term includes prevention of spread of infection in a subject exposed to the virus or at risk of having influenza infection.

As used herein a "protective effect" may be demonstrated by any standard procedure known in the art to determine whether an agent such as an anti-viral agent, or an antibody such as an anti-influenza-HA antibody of the invention can demonstrate any one or more of the following: e.g. an increase in survival after exposure to an infectious agent, a decrease in viral load, or amelioration of at least one symptom associated with the infectious agent.

As used herein, the term "anti-viral drug" refers to any anti-infective drug or therapy used to treat, prevent, or ameliorate a viral infection in a subject. The term "anti-viral drug" includes, but is not limited to TAMIFLU® (Oseltamivir), RELENZA® (Zanamivir), ribavirin, or interferon-alpha2b. In the present invention, the infection to be treated is caused by an influenza virus.

General Description

Influenza is an infectious disease caused by RNA viruses of the family Orthomyxoviridae (the influenza viruses). Influenza viruses are classified based on core protein into three genera A, B and C that are further divided into subtypes determined by the viral envelope glycoproteins hemagglutinin (HA) and neuraminidase (NA). Influenza A viruses infect a range of mammalian and avian species, whereas type B and C infections are largely restricted to humans. Only types A and B cause human disease of any concern.

High mutation rates and frequent genetic reassortments of the influenza viruses contribute to great variability of the HA and NA antigens. Minor point mutations causing small changes ("antigenic drift") occur relatively often. Antigenic drift enables the virus to evade immune recognition, resulting in repeated influenza outbreaks during interpandemic years. Major changes in the HA antigen ("antigenic shift") are caused by reassortment of genetic material from different influenza A subtypes. Antigenic shifts resulting in new pandemic strains are rare events, occurring through reassortment between animal and human subtypes, for example in co-infected pigs.

The neutralizing antibody response to Influenza A virus is typically specific for a given viral subtype. There are 18 influenza A subtypes defined by their hemagglutinin ("HA") proteins. The 18 HAs, H1-H18, can be classified into two groups. Group 1 consists of H1, H2, H5, H6, H8, H9, H11, H12, H13, H16, H17 and H18 subtypes, and group 2 includes H3, H4, H7, H10, H14 and H15 subtypes. For these reasons it would be highly desirable to have a vaccine that induces broadly neutralizing antibodies capable of neutralizing all influenza A virus subtypes as well as their yearly variants. In addition broadly neutralizing heterosubtypic antibodies could be administered as medicaments for prevention or therapy of influenza A infection.

HA is synthesized as a homo-trimeric precursor polypeptide HA0. Each monomer can be independently cleaved post-translationally to form two polypeptides, HA1 and HA2, linked by a single disulphide bond. The larger N-terminal fragment (HAL 320-330 amino acids) forms a membrane-distal globular domain that contains the receptor-binding site and most determinants recognized by virus-neutralizing antibodies. The HA1 polypeptide of HA is responsible for the attachment of virus to the cell surface. The smaller C-terminal portion (HA2, approximately 180 amino acids) forms a stem-like structure that anchors the globular domain to the cellular or viral membrane. The HA2 polypeptide mediates the fusion of viral and cell membranes in endosomes, allowing the release of the ribonucleoprotein complex into the cytoplasm.

There has only been limited success in identifying antibodies that neutralize more than one subtype of influenza A virus. Further, the breath of neutralization of antibodies identified thus far is narrow and their potency is low. Okuno et al, immunized mice with influenza virus A/Okuda/57 (H2N2) and isolated a monoclonal antibody (C179) that binds to a conserved conformational epitope in HA2 and neutralizes the Group 1 H2, H1 and H5 subtype influenza A viruses in vitro and in vivo in animal models ((Okuno et al, J. Virol. 67:2552-8, 1993).

Despite decades of research, there are no marketed antibodies that broadly neutralize or inhibit influenza A virus infection or attenuate disease caused by influenza A virus. Therefore, there is a need to identify new antibodies that neutralize multiple subtypes of influenza A virus and can be used as medicaments for prevention or therapy of influenza A infection.

Passive immunotherapy for prophylaxis or treatment of infectious diseases has been used for more than a century, usually in the form of convalescent human sera that contains high titers of neutralizing antibodies (Good et al. 1991; Cancer 68: 1415-1421). Today, multiple purified monoclonal antibodies are currently in preclinical and clinical development for use as anti-microbials (Marasco et al 2007; Nature Biotechnology 25: 1421-1434).

The inventors have described herein fully human antibodies and antigen-binding fragments thereof that specifically bind to influenza hemagglutinin and modulate the interaction of influenza virus with host cells. The anti-influenza HA antibodies may bind to the influenza virus HA with high affinity. In certain embodiments, the antibodies of the present invention are blocking antibodies wherein the antibodies may bind to influenza HA and block the attachment to and/or entry of the virus into host cells. In some embodiments, the blocking antibodies of the invention may block the binding of influenza virus to cells and as such may inhibit or neutralize viral infectivity of host cells. In some embodiments, the blocking antibodies may be useful for treating a subject suffering from an influenza virus infection. The antibodies when administered to a subject in need thereof may reduce the infection by a virus such as influenza in the subject. They may be used to decrease viral loads in a subject. They may be used alone or as adjunct therapy with other therapeutic moieties or modalities known in the art for treating a viral infection. In certain embodiments, these antibodies may bind to an epitope in the stem region of the viral HA. Furthermore, the identified antibodies can be used prophylactically (before infection) to protect a mammal from infection, or can be used therapeutically (after infection is established) to ameliorate a previously established infection, or to ameliorate at least one symptom associated with the infection.

The full-length amino acid sequence of an exemplary Influenza HA is shown in GenBank as accession number HC483324.1 (See SEQ ID NO: 62 in PCT publication WO2010/027818).

In certain embodiments, the antibodies of the invention are obtained from mice immunized with a primary immunogen, such as a full length influenza HA or with a recombinant form of influenza HA or fragments thereof followed by immunization with a secondary immunogen, or with an immunogenically active fragment of influenza HA. In certain embodiments, the antibodies are obtained from mice immunized with an influenza vaccine composition followed by booster immunization with one or more recombinantly produced HA peptides.

The immunogen may be a biologically active and/or immunogenic fragment of influenza HA or DNA encoding the active fragment thereof. The fragment may be derived from the stem region of the HA protein. (See Sui et. al., Nature Struct. and Mol. Biol. Published online 22 Feb. 2009; Pages 1-9).

The peptides may be modified to include addition or substitution of certain residues for tagging or for purposes of conjugation to carrier molecules, such as, KLH. For example, a cysteine may be added at either the N terminal or C terminal end of a peptide, or a linker sequence may be added to prepare the peptide for conjugation to, for example, KLH for immunization.

Certain anti-influenza-HA antibodies of the present invention are able to bind to and neutralize the activity of influenza-HA, as determined by in vitro or in vivo assays. The ability of the antibodies of the invention to bind to and neutralize the activity of influenza-HA and thus the attachment and/or entry of the virus into a host cell followed by the ensuing viral infection, may be measured using any standard method known to those skilled in the art, including binding assays, or activity assays, as described herein.

Non-limiting, exemplary in vitro assays for measuring binding activity are illustrated in Example 3, herein. In Example 3, the binding affinity and dissociation constants of anti-influenza-HA antibodies for influenza-HA were determined by real-time bio-layer interferometer based biosensor (Octet HTX assay). In Examples 4 and 5, neutralization assays were used to determine infectivity of diverse group 1 strains of influenza virus. In Example 6, certain antibodies were shown to mediate complement dependent cytotoxicity (CDC) of virus-infected cells in vitro. Examples 7 and 10 demonstrate that certain antibodies of the invention are capable of neutralizing an influenza A infection in vivo when administered either prophylactically or therapeutically.

The antibodies specific for influenza-HA may contain no additional labels or moieties, or they may contain an N-terminal or C-terminal label or moiety. In one embodiment, the label or moiety is biotin. In a binding assay, the location of a label (if any) may determine the orientation of the peptide relative to the surface upon which the peptide is bound. For example, if a surface is coated with avidin, a peptide containing an N-terminal biotin will be oriented such that the C-terminal portion of the peptide will be distal to the surface. In one embodiment, the label may be a radionuclide, a fluorescent dye or a MRI-detectable label. In certain embodiments, such labeled antibodies may be used in diagnostic assays including imaging assays.

Antigen-Binding Fragments of Antibodies

Unless specifically indicated otherwise, the term "antibody," as used herein, shall be understood to encompass antibody molecules comprising two immunoglobulin heavy chains and two immunoglobulin light chains (i.e., "full antibody molecules") as well as antigen-binding fragments thereof. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. The terms "antigen-binding fragment" of an antibody, or "antibody fragment", as used herein, refers to one or more fragments of an antibody that retain the ability to specifically bind to Influenza HA. An antibody fragment may include a Fab fragment, a $F(ab')_2$ fragment, a Fv fragment, a dAb fragment, a fragment containing a CDR, or an isolated CDR. In certain embodiments, the term "antigen-binding fragment" refers to a polypeptide fragment of a multi-specific antigen-binding molecule. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and (optionally) constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g. monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain may be of any size or amino acid composition and will generally comprise at least one CDR, which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_H1$-$C_H2$; (v) $V_H$-$C_H1$-$C_H2$-$C_H3$; (vi) $V_H$-$C_H2$-$C_H3$; (vii) $V_H$-$C_L$; (viii) $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids, which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be mono-specific or multi-specific (e.g., bi-specific). A multi-specific antigen-binding fragment of an antibody will typically comprise at least two different variable domains, wherein each variable domain is capable of specifically binding to a separate antigen or to a different epitope on the same antigen. Any multi-specific antibody format, including the exemplary bi-specific antibody formats disclosed herein, may be adapted for use in the context of an antigen-binding fragment of an antibody of the present invention using routine techniques available in the art.

Preparation of Human Antibodies

Methods for generating human antibodies in transgenic mice are known in the art. Any such known methods can be used in the context of the present invention to make human antibodies that specifically bind to Influenza-HA. An immunogen comprising any one of the following can be used to generate antibodies to Influenza HA. In certain embodiments, the antibodies of the invention are obtained from mice immunized with a full length, native influenza HA (See, for example, GenBank accession number FJ966082.1), or with a live attenuated or inactivated virus, or with DNA encoding the protein or fragment thereof. Alternatively, the influenza-HA protein or a fragment thereof may be produced using standard biochemical techniques and modified and used as immunogen. In one embodiment, the immunogen is a recombinantly produced influenza-HA protein or fragment thereof. In certain embodiments of the invention, the immunogen may be an influenza virus vaccine. In certain embodiments, one or more booster injections may be administered. In certain embodiments, the booster injections may comprise one or more influenza virus strains, or hemagglutinins derived from these strains, eg., See Protein Sciences H1 A/New Caledonia/20/1999, H5 A/Indonesia/05/2005, H3 A/Victoria/361/2011, H7 A/Netherlands/219/2003, or H9 A/Hong Kong/1073/1988. In certain embodiments, the booster injections may contain a 1:1 mixture of the influenza strains, or a 1:1 mixture of the hemagglutinins derived from the strains. In certain embodiments, the immunogen may be a recombinant Influenza HA peptide expressed in E. coli or in any other eukaryotic or mammalian cells such as Chinese hamster ovary (CHO) cells or influenza virus itself.

Using VELOCIMMUNE® technology (see, for example, U.S. Pat. No. 6,596,541, Regeneron Pharmaceuticals, VELOCIMMUNE®) or any other known method for generating monoclonal antibodies, high affinity chimeric antibodies to influenza-HA are initially isolated having a human variable region and a mouse constant region. The VELOCIMMUNE® technology involves generation of a transgenic mouse having a genome comprising human heavy and light chain variable regions operably linked to endogenous mouse constant region loci such that the mouse produces an antibody comprising a human variable region and a mouse constant region in response to antigenic stimulation. The DNA encoding the variable regions of the heavy and light chains of the antibody are isolated and operably linked to DNA encoding the human heavy and light chain constant regions. The DNA is then expressed in a cell capable of expressing the fully human antibody.

Generally, a VELOCIMMUNE® mouse is challenged with the antigen of interest, and lymphatic cells (such as B-cells) are recovered from the mice that express antibodies. The lymphatic cells may be fused with a myeloma cell line to prepare immortal hybridoma cell lines, and such hybridoma cell lines are screened and selected to identify hybridoma cell lines that produce antibodies specific to the antigen of interest. DNA encoding the variable regions of the heavy chain and light chain may be isolated and linked to desirable isotypic constant regions of the heavy chain and light chain. Such an antibody protein may be produced in a cell, such as a CHO cell. Alternatively, DNA encoding the antigen-specific chimeric antibodies or the variable domains of the light and heavy chains may be isolated directly from antigen-specific lymphocytes.

Initially, high affinity chimeric antibodies are isolated having a human variable region and a mouse constant region. As in the experimental section below, the antibodies are characterized and selected for desirable characteristics, including affinity, selectivity, epitope, etc. The mouse constant regions are replaced with a desired human constant region to generate the fully human antibody of the invention, for example wild-type or modified IgG1 or IgG4. While the constant region selected may vary according to specific use, high affinity antigen-binding and target specificity characteristics reside in the variable region.

Bioequivalents

The anti-influenza-HA antibodies and antibody fragments of the present invention encompass proteins having amino acid sequences that vary from those of the described antibodies, but that retain the ability to bind Influenza HA. Such variant antibodies and antibody fragments comprise one or more additions, deletions, or substitutions of amino acids when compared to parent sequence, but exhibit biological activity that is essentially equivalent to that of the described antibodies. Likewise, the antibody-encoding DNA sequences of the present invention encompass sequences that comprise one or more additions, deletions, or substitutions of nucleotides when compared to the disclosed sequence, but that encode an antibody or antibody fragment that is essentially bioequivalent to an antibody or antibody fragment of the invention.

Two antigen-binding proteins, or antibodies, are considered bioequivalent if, for example, they are pharmaceutical equivalents or pharmaceutical alternatives whose rate and extent of absorption do not show a significant difference when administered at the same molar dose under similar experimental conditions, either single dose or multiple doses. Some antibodies will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins are bioequivalent if there are no clinically meaningful differences in their safety, purity, or potency.

In one embodiment, two antigen-binding proteins are bioequivalent if a patient can be switched one or more times between the reference product and the biological product without an expected increase in the risk of adverse effects, including a clinically significant change in immunogenicity, or diminished effectiveness, as compared to continued therapy without such switching.

In one embodiment, two antigen-binding proteins are bioequivalent if they both act by a common mechanism or mechanisms of action for the condition or conditions of use, to the extent that such mechanisms are known.

Bioequivalence may be demonstrated by in vivo and/or in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) in a well-controlled clinical trial that establishes safety, efficacy, or bioavailability or bioequivalence of an antibody.

Bioequivalent variants of the antibodies of the invention may be constructed by, for example, making various substitutions of residues or sequences or deleting terminal or internal residues or sequences not needed for biological activity. For example, cysteine residues not essential for biological activity can be deleted or replaced with other amino acids to prevent formation of unnecessary or incorrect intramolecular disulfide bridges upon renaturation. In other contexts, bioequivalent antibodies may include antibody variants comprising amino acid changes, which modify the glycosylation characteristics of the antibodies, e.g., mutations that eliminate or remove glycosylation.

Anti-Influenza-HA Antibodies Comprising Fc Variants

According to certain embodiments of the present invention, anti-influenza-HA antibodies are provided comprising an Fc domain comprising one or more mutations, which enhance or diminish antibody binding to the FcRn receptor, e.g., at acidic pH as compared to neutral pH. For example, the present invention includes anti-influenza-HA antibodies comprising a mutation in the $C_H2$ or a $C_H3$ region of the Fc domain, wherein the mutation(s) increases the affinity of the Fc domain to FcRn in an acidic environment (e.g., in an endosome where pH ranges from about 5.5 to about 6.0). Such mutations may result in an increase in serum half-life of the antibody when administered to an animal. Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256

(e.g., S/R/Q/E/D or T); or a modification at position 428 and/or 433 (e.g., H/L/R/S/P/Q or K) and/or 434 (e.g., A, W, H, F or Y [N434A, N434W, N434H, N434F or N434Y]); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P). In yet another embodiment, the modification comprises a 265A (e.g., D265A) and/or a 297A (e.g., N297A) modification.

For example, the present invention includes anti-influenza-HA antibodies comprising an Fc domain comprising one or more pairs or groups of mutations selected from the group consisting of: 250Q and 248L (e.g., T250Q and M248L); 252Y, 254T and 256E (e.g., M252Y, S254T and T256E); 428L and 434S (e.g., M428L and N434S); 257I and 311I (e.g., P257I and Q311I); 257I and 434H (e.g., P257I and N434H); 376V and 434H (e.g., D376V and N434H); 307A, 380A and 434A (e.g., T307A, E380A and N434A); and 433K and 434F (e.g., H433K and N434F). All possible combinations of the foregoing Fc domain mutations and other mutations within the antibody variable domains disclosed herein, are contemplated within the scope of the present invention.

The present invention also includes anti-influenza-HA antibodies comprising a chimeric heavy chain constant ($C_H$) region, wherein the chimeric $C_H$ region comprises segments derived from the $C_H$ regions of more than one immunoglobulin isotype. For example, the antibodies of the invention may comprise a chimeric $C_H$ region comprising part or all of a $C_H2$ domain derived from a human IgG1, human IgG2 or human IgG4 molecule, combined with part or all of a $C_H3$ domain derived from a human IgG1, human IgG2 or human IgG4 molecule. According to certain embodiments, the antibodies of the invention comprise a chimeric $C_H$ region having a chimeric hinge region. For example, a chimeric hinge may comprise an "upper hinge" amino acid sequence (amino acid residues from positions 216 to 227 according to EU numbering) derived from a human IgG1, a human IgG2 or a human IgG4 hinge region, combined with a "lower hinge" sequence (amino acid residues from positions 228 to 236 according to EU numbering) derived from a human IgG1, a human IgG2 or a human IgG4 hinge region. According to certain embodiments, the chimeric hinge region comprises amino acid residues derived from a human IgG1 or a human IgG4 upper hinge and amino acid residues derived from a human IgG2 lower hinge. An antibody comprising a chimeric $C_H$ region as described herein may, in certain embodiments, exhibit modified Fc effector functions without adversely affecting the therapeutic or pharmacokinetic properties of the antibody. (See, e.g., U.S. Provisional Appl. No. 61/759,578, filed Feb. 1, 2013, the disclosure of which is hereby incorporated by reference in its entirety).

Biological Characteristics of the Antibodies

In general, the antibodies of the present invention function by binding to Influenza HA. For example, the present invention includes antibodies and antigen-binding fragments of antibodies that bind Influenza HA (e.g., at 25° C. or at 37° C.) with a $K_D$ of less than 10 nM, as measured by real-time bio-layer interferometer based biosensor (Octet HTX assay), or by surface plasmon resonance. In certain embodiments, the antibodies or antigen-binding fragments thereof bind influenza-HA with a $K_D$ of less than about 5 nM, less than about 2 nM, less than about 1 nM, less than about 500 pM, less than 250 pM, or less than 100 pM, as measured by surface plasmon resonance, e.g., using the assay format as described herein, or a substantially similar assay.

The present invention also includes antibodies and antigen-binding fragments thereof that bind Influenza HA with a dissociative half-life (t½) of greater than about 100 minutes as measured by surface plasmon resonance at 25° C., e.g., using an assay format as defined herein, or a substantially similar assay. In certain embodiments, the antibodies or antigen-binding fragments of the present invention bind Influenza HA with a t½ of greater than about 200 minutes, greater than about 300 minutes, greater than about 400 minutes, greater than about 500 minutes, greater than about 600 minutes, greater than about 700 minutes, greater than about 800 minutes, greater than about 900 minutes, or greater than about 1000 minutes as measured by surface plasmon resonance at 25° C., e.g., using an assay format as defined herein (e.g., mAb-capture or antigen-capture format), or a substantially similar assay. In one embodiment, the antibodies and antigen-binding fragments of the invention bind Influenza HA with a dissociative half-life (t½) of greater than 300 minutes. In one embodiment, an antibody of the invention provides for about a 1.5 to 2-fold increase in dissociative half life as compared to a comparator antibody designated Control I mAb, when tested in monkeys and mice.

The present invention also includes antibodies or antigen-binding fragments thereof that neutralize the infectivity of influenza virus for its host cells. In some embodiments, the antibodies exhibit a neutralization potency against various representative group 1 influenza viruses (H1N1 A/Puerto Rico/08/1934; H5N1 A/Vietnam/1203/2004; H1N1 A/California/07/2009; H1N1 A/Wisconsin/1933; H1N1 A/Brisbane/59/1997, H9N2 A/Hong Kong/33982/2009, H13N6 a/gull/Maryland/704/1977 and H16N3 A/shorebird/Delaware/172/2006 with an $IC_{50}$ ranging from about 1.6 nM to about 130 nM in a microneutralization assay, e.g., as shown in Examples 4 and 5, or a substantially similar assay. In one embodiment, the antibodies or antigen-binding fragments thereof that neutralize the infectivity of influenza virus for its host cells do so with an $IC_{50}$ of less than 130 nM.

The present invention also includes antibodies or antigen-binding fragments thereof that mediate complement-dependent cytotoxicity of infected cells, with an $EC_{50}$ ranging from about 20 nM to about 66 nM (see example 6). In one embodiment, the antibodies or antigen-binding fragments thereof mediate complement-dependent cytotoxicity of infected cells, with an $EC_{50}$ less than 66 nM.

The present invention also includes anti-influenza-A HA antibodies that demonstrate an increase in protection, or potent neutralization of influenza A infection in vivo. Certain antibodies show potent neutralization when administered either prophylactically (prior to infection) or therapeutically (after infection; see example 7). In certain embodiments, some of the antibodies (H1H11729P and H1H11829N2) demonstrated 100% survival of mice when administered prophylactically as a single dose of 1 mg/kg. Certain antibodies demonstrated significant survival of mice when administered prophylactically at doses as low as 0.5 mg/kg (100% survival using the antibody designated as H1H11729P), at 0.1 mg/kg of H1H11729P (40% survival), or at 0.05 mg/kg of H1H11829N2 (20% survival). Significant survival was also observed when certain exemplary antibodies (H1H11829N2 and H1H11729P) were administered after infection at doses of 15 or 30 mg/kg. In one embodiment, an antibody of the invention demonstrates an additive protective effect in influenza-infected mammals when combined with an anti-viral drug, oseltamivir.

In one embodiment, the invention provides an isolated recombinant antibody or antigen-binding fragment thereof that binds specifically to Influenza HA, wherein the antibody or fragment thereof exhibits two or more of the following characteristics: (a) is a fully human monoclonal antibody; (b) binds to influenza HA with a dissociation constant ($K_D$) of less than $10^{-9}$M, as measured in a surface plasmon resonance assay; (c) demonstrates a dissociative half-life (t½) ranging from about 370 minutes to greater than 1000 minutes; (d) demonstrates neutralization of group 1 influenza A viruses selected from H1N1, H5N1, H9N2, H13N6 and H16N3, with an $IC_{50}$ ranging from about 1.6 nM to about 130 nM; (e) demonstrates complement mediated lysis of influenza virus infected cells with an $EC_{50}$ of about 20 nM to about 66 nM; or (f) demonstrates protection, as measured by increased survival in an animal model of influenza virus infection when administered either before or after virus challenge.

The antibodies of the present invention may possess two or more of the aforementioned biological characteristics, or any combinations thereof. Other biological characteristics of the antibodies of the present invention will be evident to a person of ordinary skill in the art from a review of the present disclosure including the working Examples herein.

Epitope Mapping and Related Technologies

The present invention includes anti-influenza-HA virus antibodies, which interact with one or more amino acids found within one or more domains of the influenza HA molecule. The epitope to which the antibodies bind may consist of a single contiguous sequence of 3 or more (e.g., 3, 4, 5, 6, 7, 8, 9, 10, 11, 12, 13, 14, 15, 16, 17, 18, 19, 20 or more) amino acids located within the influenza HA molecule (e.g. a linear epitope in a domain). Alternatively, the epitope may consist of a plurality of non-contiguous amino acids (or amino acid sequences) located within the influenza-HA molecule (e.g. a conformational epitope).

Various techniques known to persons of ordinary skill in the art can be used to determine whether an antibody "interacts with one or more amino acids" within a polypeptide or protein. Exemplary techniques include, for example, routine cross-blocking assays, such as that described in Antibodies, Harlow and Lane (Cold Spring Harbor Press, Cold Spring Harbor, N.Y.). Other methods include alanine scanning mutational analysis, peptide blot analysis (Reineke (2004) Methods Mol. Biol. 248: 443-63), peptide cleavage analysis crystallographic studies and NMR analysis. In addition, methods such as epitope excision, epitope extraction and chemical modification of antigens can be employed (Tomer (2000) Prot. Sci. 9: 487-496). Another method that can be used to identify the amino acids within a polypeptide with which an antibody interacts is hydrogen/deuterium exchange detected by mass spectrometry. In general terms, the hydrogen/deuterium exchange method involves deuterium-labeling the protein of interest, followed by binding the antibody to the deuterium-labeled protein. Next, the protein/antibody complex is transferred to water and exchangeable protons within amino acids that are protected by the antibody complex undergo deuterium-to-hydrogen back-exchange at a slower rate than exchangeable protons within amino acids that are not part of the interface. As a result, amino acids that form part of the protein/antibody interface may retain deuterium and therefore exhibit relatively higher mass compared to amino acids not included in the interface. After dissociation of the antibody, the target protein is subjected to protease cleavage and mass spectrometry analysis, thereby revealing the deuterium-labeled residues which correspond to the specific amino acids with which the antibody interacts. See, e.g., Ehring (1999) Analytical Biochemistry 267: 252-259; Engen and Smith (2001) Anal. Chem. 73: 256A-265A.

The term "epitope" refers to a site on an antigen to which B and/or T cells respond. B-cell epitopes can be formed both from contiguous amino acids or noncontiguous amino acids juxtaposed by tertiary folding of a protein. Epitopes formed from contiguous amino acids are typically retained on exposure to denaturing solvents, whereas epitopes formed by tertiary folding are typically lost on treatment with denaturing solvents. An epitope typically includes at least 3, and more usually, at least 5 or 8-10 amino acids in a unique spatial conformation.

Modification-Assisted Profiling (MAP), also known as Antigen Structure-based Antibody Profiling (ASAP) is a method that categorizes large numbers of monoclonal antibodies (mAbs) directed against the same antigen according to the similarities of the binding profile of each antibody to chemically or enzymatically modified antigen surfaces (see US 2004/0101920, herein specifically incorporated by reference in its entirety). Each category may reflect a unique epitope either distinctly different from or partially overlapping with epitope represented by another category. This technology allows rapid filtering of genetically identical antibodies, such that characterization can be focused on genetically distinct antibodies. When applied to hybridoma screening, MAP may facilitate identification of rare hybridoma clones that produce mAbs having the desired characteristics. MAP may be used to sort the antibodies of the invention into groups of antibodies binding different epitopes.

In certain embodiments, the influenza virus-HA antibodies or antigen-binding fragments thereof bind an epitope within any one or more of the regions exemplified in influenza HA, either in natural form, or recombinantly produced, or to a fragment thereof.

The present invention includes anti-influenza-HA antibodies that bind to the same epitope, or a portion of the epitope. Likewise, the present invention also includes anti-influenza-HA antibodies that compete for binding to Influenza HA or a fragment thereof with any of the specific exemplary antibodies described herein. For example, the present invention includes anti-influenza-HA antibodies that cross-compete for binding to influenza HA with one or more antibodies obtained from those antibodies described in Tables 1 and 12.

One can easily determine whether an antibody binds to the same epitope as, or competes for binding with, a reference anti-influenza-HA antibody by using routine methods known in the art. For example, to determine if a test antibody binds to the same epitope as a reference anti-influenza-HA antibody of the invention, the reference antibody is allowed to bind to an Influenza HA or peptide under saturating conditions. Next, the ability of a test antibody to bind to the Influenza HA molecule is assessed. If the test antibody is able to bind to influenza virus HA following saturation binding with the reference anti-influenza-HA antibody, it can be concluded that the test antibody binds to a different epitope than the reference anti-influenza-HA antibody. On the other hand, if the test antibody is not able to bind to the Influenza HA following saturation binding with the reference anti-influenza-HA antibody, then the test antibody may bind to the same epitope as the epitope bound by the reference anti-influenza-HA antibody of the invention.

To determine if an antibody competes for binding with a reference anti-influenza-HA antibody, the above-described binding methodology is performed in two orientations: In a first orientation, the reference antibody is allowed to bind to a Influenza HA under saturating conditions followed by assessment of binding of the test antibody to the influenza-HA molecule. In a second orientation, the test antibody is allowed to bind to an influenza-HA molecule under saturating conditions followed by assessment of binding of the reference antibody to the influenza-HA molecule. If, in both orientations, only the first (saturating) antibody is capable of binding to the influenza-HA molecule, then it is concluded that the test antibody and the reference antibody compete for binding to influenza-HA. As will be appreciated by a person of ordinary skill in the art, an antibody that competes for binding with a reference antibody may not necessarily bind to the identical epitope as the reference antibody, but may sterically block binding of the reference antibody by binding an overlapping or adjacent epitope.

Two antibodies bind to the same or overlapping epitope if each competitively inhibits (blocks) binding of the other to the antigen. That is, a 1-, 5-, 10-, 20- or 100-fold excess of one antibody inhibits binding of the other by at least 50% but preferably 75%, 90% or even 99% as measured in a competitive binding assay (see, e.g., Junghans et al., Cancer Res. 1990 50:1495-1502). Alternatively, two antibodies have the same epitope if essentially all amino acid mutations in the antigen that reduce or eliminate binding of one antibody reduce or eliminate binding of the other. Two antibodies have overlapping epitopes if some amino acid mutations that reduce or eliminate binding of one antibody reduce or eliminate binding of the other.

Additional routine experimentation (e.g., peptide mutation and binding analyses) can then be carried out to confirm whether the observed lack of binding of the test antibody is in fact due to binding to the same epitope as the reference antibody or if steric blocking (or another phenomenon) is responsible for the lack of observed binding. Experiments of this sort can be performed using ELISA, RIA, surface plasmon resonance, flow cytometry or any other quantitative or qualitative antibody-binding assay available in the art.

Immunoconjugates

The invention encompasses a human anti-influenza-HA monoclonal antibody conjugated to a therapeutic moiety ("immunoconjugate"), such as a toxoid or an anti-viral drug to treat influenza virus infection. As used herein, the term "immunoconjugate" refers to an antibody, which is chemically or biologically linked to a radioactive agent, a cytokine, an interferon, a target or reporter moiety, an enzyme, a peptide or protein or a therapeutic agent. The antibody may be linked to the radioactive agent, cytokine, interferon, target or reporter moiety, enzyme, peptide or therapeutic agent at any location along the molecule so long as it is able to bind its target. Examples of immunoconjugates include antibody drug conjugates and antibody-toxin fusion proteins. In one embodiment, the agent may be a second different antibody to Influenza-HA. In certain embodiments, the antibody may be conjugated to an agent specific for a virally infected cell. The type of therapeutic moiety that may be conjugated to the anti-influenza-HA antibody and will take into account the condition to be treated and the desired therapeutic effect to be achieved. Examples of suitable agents for forming immunoconjugates are known in the art; see for example, Multi-Specific Antibodies The antibodies of the present invention may be mono-specific, bi-specific, or multi-specific. Multi-specific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244.

Any of the multi-specific antigen-binding molecules of the invention, or variants thereof, may be constructed using standard molecular biological techniques (e.g., recombinant DNA and protein expression technology), as will be known to a person of ordinary skill in the art.

In some embodiments, influenza-HA-specific antibodies are generated in a bi-specific format (a "bi-specific") in which variable regions binding to distinct domains of Influenza HA are linked together to confer dual-domain specificity within a single binding molecule. Appropriately designed bi-specifics may enhance overall influenza-HA-protein inhibitory efficacy through increasing both specificity and binding avidity. Variable regions with specificity for individual domains, (e.g., segments of the N-terminal domain), or that can bind to different regions within one domain, are paired on a structural scaffold that allows each region to bind simultaneously to the separate epitopes, or to different regions within one domain. In one example for a bi-specific, heavy chain variable regions ($V_H$) from a binder with specificity for one domain are recombined with light chain variable regions ($V_L$) from a series of binders with specificity for a second domain to identify non-cognate $V_L$ partners that can be paired with an original $V_H$ without disrupting the original specificity for that $V_H$. In this way, a single $V_L$ segment (e.g., $V_L1$) can be combined with two different $V_H$ domains (e.g., $V_H1$ and $V_H2$) to generate a bi-specific comprised of two binding "arms" ($V_H1$-$V_L1$ and $V_H2$-$V_L1$). Use of a single $V_L$ segment reduces the complexity of the system and thereby simplifies and increases efficiency in cloning, expression, and purification processes used to generate the bi-specific (See, for example, U.S. Ser. No. 13/022,759 and US2010/0331527).

Alternatively, antibodies that bind more than one domain and a second target, such as, but not limited to, for example, a second different anti-influenza-HA antibody, may be prepared in a bi-specific format using techniques described herein, or other techniques known to those skilled in the art. Antibody variable regions binding to distinct regions may be linked together with variable regions that bind to relevant sites on, for example, the influenza virus, to confer dual-antigen specificity within a single binding molecule. Appropriately designed bi-specifics of this nature serve a dual function. Variable regions with specificity for the extracellular domain are combined with a variable region with specificity for outside the extracellular domain and are paired on a structural scaffold that allows each variable region to bind to the separate antigens.

An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). Further modifications that may be found within the second $C_H3$ include:

D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N384S, K392N, V397M, R409K, E419Q, and V422I by EU) in the case of IgG4 antibodies. Variations on the bi-specific antibody format described above are contemplated within the scope of the present invention.

Other exemplary bispecific formats that can be used in the context of the present invention include, without limitation, e.g., scFv-based or diabody bispecific formats, IgG-scFv fusions, dual variable domain (DVD)-Ig, Quadroma, knobs-into-holes, common light chain (e.g., common light chain with knobs-into-holes, etc.), CrossMab, CrossFab, (SEED) body, leucine zipper, Duobody, IgG1/IgG2, dual acting Fab (DAF)-IgG, and Mab$^2$ bispecific formats (see, e.g., Klein et al. 2012, mAbs 4:6, 1-11, and references cited therein, for a review of the foregoing formats). Bispecific antibodies can also be constructed using peptide/nucleic acid conjugation, e.g., wherein unnatural amino acids with orthogonal chemical reactivity are used to generate site-specific antibody-oligonucleotide conjugates which then self-assemble into multimeric complexes with defined composition, valency and geometry. (See, e.g., Kazane et al., *J. Am. Chem. Soc.* [Epub: Dec. 4, 2012]).

Therapeutic Administration and Formulations

The invention provides therapeutic compositions comprising the anti-influenza-HA antibodies or antigen-binding fragments thereof of the present invention. Therapeutic compositions in accordance with the invention will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of antibody may vary depending upon the age and the size of a subject to be administered, target disease, conditions, route of administration, and the like. When an antibody of the present invention is used for treating a disease or disorder in an adult patient, or for preventing such a disease, it is advantageous to administer the antibody of the present invention normally at a single dose of about 0.1 to about 60 mg/kg body weight, more preferably about 5 to about 60, about 10 to about 50, or about 20 to about 50 mg/kg body weight. Depending on the severity of the condition, the frequency and the duration of the treatment can be adjusted. In certain embodiments, the antibody or antigen-binding fragment thereof of the invention can be administered as an initial dose of at least about 0.1 mg to about 5000 mg, about 1 to about 2000 mg, about 5 to about 1000 mg, or about 10 to about 500 mg, to about 100 mg, or to about 50 mg. In certain embodiments, the initial dose may be followed by administration of a second or a plurality of subsequent doses of the antibody or antigen-binding fragment thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu et al. (1987) J. Biol. Chem. 262:4429-4432). Methods of introduction include, but are not limited to, intradermal, transdermal, intramuscular, intraperitoneal, intravenous, subcutaneous, intranasal, epidural and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. The pharmaceutical composition can be also delivered in a vesicle, in particular a liposome (see, for example, Langer (1990) Science 249: 1527-1533).

The use of nanoparticles to deliver the antibodies of the present invention is also contemplated herein. Antibody-conjugated nanoparticles may be used both for therapeutic and diagnostic applications. Antibody-conjugated nanoparticles and methods of preparation and use are described in detail by Arruebo, M., et al. 2009 ("Antibody-conjugated nanoparticles for biomedical applications" in J. Nanomat. Volume 2009, Article ID 439389, 24 pages, doi: 10.1155/2009/439389), incorporated herein by reference. Nanoparticles may be developed and conjugated to antibodies contained in pharmaceutical compositions to target virally infected cells. Nanoparticles for drug delivery have also been described in, for example, U.S. Pat. No. 8,257,740, or U.S. Pat. No. 8,246,995, each incorporated herein in its entirety.

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous, intracranial, intraperitoneal and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™, OPTIPEN STARLET™, and OPTICLIK™ (Sanofi-Aventis, Frankfurt, Germany), to name only a few. Examples of disposable pen delivery devices having applications in subcutaneous delivery of a pharmaceutical composition of the present invention include, but certainly are not limited to the SOLOSTAR™ pen (Sanofi-Aventis), the FLEXPEN™ (Novo Nordisk), and the KWIKPEN™ (Eli Lilly), the SURECLICK™ Autoinjector (Amgen, Thousand Oaks, Calif.), the PENLET™ (Haselmeier, Stuttgart, Germany), the EPIPEN (Dey, L. P.) and the HUMIRA™ Pen (Abbott Labs, Abbott Park, Ill.), to name only a few.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the antibody contained is generally about 5 to about 5000 mg per dosage form in a unit dose; especially in the form of injection, it is preferred that the antibody is contained in about 5 to about 500 mg and in about 10 to about 250 mg for the other dosage forms.

Therapeutic Uses of the Antibodies

The antibodies of the present invention are useful for the treatment, and/or prevention of a disease or disorder or condition associated with influenza virus infection and/or for ameliorating at least one symptom associated with such disease, disorder or condition.

In certain embodiments, the antibodies of the invention are useful to treat subjects suffering from the severe and acute respiratory infection caused by influenza virus. In some embodiments, the antibodies of the invention are useful in decreasing viral titers or reducing viral load in the host. In one embodiment, an antibody or antigen-binding fragment thereof the invention may be administered at a therapeutic dose to a patient with influenza virus infection.

One or more antibodies of the present invention may be administered to relieve or prevent or decrease the severity of one or more of the symptoms or conditions of the disease or disorder. The antibodies may be used to ameliorate or reduce the severity of at least one symptom of influenza virus infection including, but not limited to fever, cough, sore throat, headache, body aches, fatigue, extreme exhaustion, shortness of breath, bronchitis, pneumonia, and death.

It is also contemplated herein to use one or more antibodies of the present invention prophylactically to subjects at risk for developing an influenza virus infection such as immunocompromised individuals, elderly adults (more than 65 years of age), children younger than 2 years of age, healthcare workers, family members in close proximity to a patient suffering from an influenza virus infection, and patients with a medical history (e.g., increased risk of pulmonary infection, heart disease or diabetes).

In a further embodiment of the invention the present antibodies are used for the preparation of a pharmaceutical composition for treating patients suffering from an influenza virus infection. In another embodiment of the invention, the present antibodies are used as adjunct therapy with any other agent or any other therapy known to those skilled in the art useful for treating or ameliorating an influenza virus infection.

Combination Therapies

Combination therapies may include an anti-influenza-HA antibody of the invention and any additional therapeutic agent that may be advantageously combined with an antibody of the invention, or with a biologically active fragment of an antibody of the invention. The antibodies of the present invention may be combined synergistically with one or more drugs or agents (e.g. anti-viral agents) used to treat influenza virus.

For example, exemplary anti-viral agents include, e.g., vaccines, neuraminidase inhibitors or nucleoside analogs. Other exemplary anti-viral agents that may be used in combination with an antibody of the invention can include, e.g., zidovudine, gangcyclovir, vidarabine, idoxuridine, trifluridine, foscarnet, acyclovir, ribavirin, amantadine, remantidine, saquinavir, indinavir, ritonavir, alpha-interferons and other interferons, a neuraminidase inhibitor (e.g., zanamivir (RELENZA®), oseltamivir (TAMIFLU®) laninamivir, peramivir), or rimantadine.

Other exemplary anti-viral drugs include, but are not limited to, a HA inhibitor, a sialic acid inhibitor and an M2 ion channel inhibitor. In one embodiment, the M2 ion channel inhibitor is amantadine or rimantadine.

In some embodiments, the antibodies of the invention may be combined with a second therapeutic agent to reduce the viral load in a patient with an influenza virus infection, or to ameliorate one or more symptoms of the infection.

The antibodies of the present invention may be used in combination with an anti-inflammatory drug (e.g., corticosteroids, and non-steroidal anti-inflammatory drugs), a decongestant, an anti-histamine, an anti-infective drug, a different antibody to Influenza virus, an anti-viral drug, a vaccine for influenza virus, such as FLUMIST® or FLUVIRIN®, a dietary supplement such as anti-oxidants or any other palliative therapy to treat an influenza virus infection.

In certain embodiments, the second therapeutic agent is another antibody to influenza. In certain embodiments, the second therapeutic agent is another antibody to influenza hemagglutinin. In certain embodiments, the second therapeutic agent is another antibody to a different influenza protein, such as the neuraminidase, or the tetrameric ectodomain of matrix protein 2 (M2e protein). In certain embodiments, the second therapeutic agent is an antibody to a different protein such as the host transmembrane protease, serine 2 (TMPRSS2). The second antibody may be specific for one or more different influenza virus proteins from different subtypes or strains of the virus. It is contemplated herein to use a combination ("cocktail") of antibodies with broad neutralization or inhibitory activity against influenza virus. In some embodiments, non-competing antibodies may be combined and administered to a subject in need thereof, to reduce the ability of influenza virus to escape due to rapid mutation as a result of selection pressure. In some embodiments, the antibodies comprising the combination bind to distinct non-overlapping epitopes on the HA protein. The antibodies comprising the combination may block the virus attachment and/or entry into and/or fusion with host cells. The antibodies may interact with a hemagglutinin selected from any one or more of the Group 1 influenza A subtypes including H1, H2, H5, H6, H8, H9, H11, H12, H13, H16, H17 or H18 and when used alone, or in combination with any one or more of the agents noted above, may neutralize any one or more of the Group 1 influenza subtypes including, but not limited to the following: H1N1, H5N1, H9N2, H13N6 and H16N3.

It is also contemplated herein to use a combination of anti-influenza-HA antibodies of the present invention, wherein the combination comprises one or more antibodies that do not cross-compete; In some embodiments, the combination includes a first antibody with broad neutralization activity with a second antibody with activity against a narrow spectrum of isolates and that does not cross-compete with the first antibody.

As used herein, the term "in combination with" means that additional therapeutically active component(s) may be administered prior to, concurrent with, or after the administration of the anti-influenza-HA antibody of the present invention. The term "in combination with" also includes sequential or concomitant administration of an anti-influenza-HA antibody and a second therapeutic agent.

The additional therapeutically active component(s) may be administered to a subject prior to administration of an anti-influenza-HA antibody of the present invention. For example, a first component may be deemed to be administered "prior to" a second component if the first component is administered 1 week before, 72 hours before, 60 hours before, 48 hours before, 36 hours before, 24 hours before, 12 hours before, 6 hours before, 5 hours before, 4 hours before, 3 hours before, 2 hours before, 1 hour before, 30 minutes before, 15 minutes before, 10 minutes before, 5 minutes before, or less than 1 minute before administration of the second component. In other embodiments, the additional therapeutically active component(s) may be administered to a subject after administration of an anti-influenza-HA antibody of the present invention. For example, a first component may be deemed to be administered "after" a second component if the first component is administered 1 minute after, 5 minutes after, 10 minutes after, 15 minutes after, 30 minutes after, 1 hour after, 2 hours after, 3 hours after, 4 hours after, 5 hours after, 6 hours after, 12 hours after, 24 hours after, 36 hours after, 48 hours after, 60 hours after, 72 hours after administration of the second component. In yet other embodiments, the additional therapeutically active component(s) may be administered to a subject concurrent with administration of an anti-influenza-HA antibody of the present invention. "Concurrent" administration, for purposes of the present invention, includes, e.g., administration of an anti-influenza-HA antibody and an additional therapeutically active component to a subject in a single dosage form, or in separate dosage forms administered to the subject within about 30 minutes or less of each other. If administered in separate dosage forms, each dosage form may be administered via the same route (e.g., both the anti-influenza-HA antibody and the additional therapeutically active component may be administered intravenously, etc.); alternatively, each dosage form may be administered via a different route (e.g., the anti-influenza-HA antibody may be administered intravenously, and the additional therapeutically active component may be administered orally). In any event, administering the components in a single dosage from, in separate dosage forms by the same route, or in separate dosage forms by different routes are all considered "concurrent administration," for purposes of the present disclosure. For purposes of the present disclosure, administration of an anti-influenza-HA antibody "prior to", "concurrent with," or "after" (as those terms are defined herein above) administration of an additional therapeutically active component is considered administration of an anti-influenza-HA antibody "in combination with" an additional therapeutically active component.

The present invention includes pharmaceutical compositions in which an anti-influenza-HA antibody of the present invention is co-formulated with one or more of the additional therapeutically active component(s) as described elsewhere herein.

Administration Regimens

According to certain embodiments, a single dose of an anti-influenza-HA antibody of the invention (or a pharmaceutical composition comprising a combination of an anti-influenza-HA antibody and any of the additional therapeutically active agents mentioned herein) may be administered to a subject in need thereof. According to certain embodiments of the present invention, multiple doses of an anti-influenza-HA antibody (or a pharmaceutical composition comprising a combination of an anti-influenza-HA antibody and any of the additional therapeutically active agents mentioned herein) may be administered to a subject over a defined time course. The methods according to this aspect of the invention comprise sequentially administering to a subject multiple doses of an anti-influenza-HA antibody of the invention. As used herein, "sequentially administering" means that each dose of anti-influenza-HA antibody is administered to the subject at a different point in time, e.g., on different days separated by a predetermined interval (e.g., hours, days, weeks or months). The present invention includes methods which comprise sequentially administering to the patient a single initial dose of an anti-influenza-HA antibody, followed by one or more secondary doses of the anti-influenza-HA antibody, and optionally followed by one or more tertiary doses of the anti-influenza-HA antibody.

The terms "initial dose," "secondary doses," and "tertiary doses," refer to the temporal sequence of administration of the anti-influenza-HA antibody of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of anti-influenza-HA antibody, but generally may differ from one another in terms of frequency of administration. In certain embodiments, however, the amount of anti-influenza-HA antibody contained in the initial, secondary and/or tertiary doses varies from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In certain exemplary embodiments of the present invention, each secondary and/or tertiary dose is administered 1 to 48 hours (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) after the immediately preceding dose. The phrase "the immediately preceding dose," as used herein, means, in a sequence of multiple administrations, the dose of anti-influenza-HA antibody, which is administered to a patient prior to the administration of the very next dose in the sequence with no intervening doses.

The methods according to this aspect of the invention may comprise administering to a patient any number of secondary and/or tertiary doses of an anti-influenza-HA antibody. For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In certain embodiments of the invention, the frequency at which the secondary and/or tertiary doses are administered to a patient can vary over the course of the treatment regimen. The frequency of administration may also be adjusted during the course of treatment by a physician depending on the needs of the individual patient following clinical examination.

Diagnostic Uses of the Antibodies

The anti-influenza-HA antibodies of the present invention may be used to detect and/or measure influenza-HA in a sample, e.g., for diagnostic purposes. Some embodiments contemplate the use of one or more antibodies of the present invention in assays to detect a disease or disorder such as viral infection. Exemplary diagnostic assays for influenza-HA may comprise, e.g., contacting a sample, obtained from a patient, with an anti-influenza-HA antibody of the invention, wherein the anti-influenza-HA antibody is labeled with a detectable label or reporter molecule or used as a capture ligand to selectively isolate influenza-HA from patient samples. Alternatively, an unlabeled anti-influenza-HA antibody can be used in diagnostic applications in combination with a secondary antibody which is itself detectably labeled. The detectable label or reporter molecule can be a radioisotope, such as $^{3}$H, $^{14}$C, $^{32}$P, $^{35}$S, or $^{125}$I; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure influenza-HA in a sample include enzyme-linked immunosorbent assay (ELISA), radioimmunoassay (RIA), and fluorescence-activated cell sorting (FACS).

Samples that can be used in influenza-HA diagnostic assays according to the present invention include any tissue or fluid sample obtainable from a patient, which contains detectable quantities of either influenza HA, or fragments thereof, under normal or pathological conditions. Generally, levels of influenza HA in a particular sample obtained from a healthy patient (e.g., a patient not afflicted with a disease associated with influenza will be measured to initially establish a baseline, or standard, level of influenza-HA. This baseline level of influenza-HA can then be compared against the levels of influenza-HA measured in samples obtained from individuals suspected of having a influenza-HA-associated condition, or symptoms associated with such condition.

The antibodies specific for influenza HA may contain no additional labels or moieties, or they may contain an N-terminal or C-terminal label or moiety. In one embodiment, the label or moiety is biotin. In a binding assay, the location of a label (if any) may determine the orientation of the peptide relative to the surface upon which the peptide is bound. For example, if a surface is coated with avidin, a peptide containing an N-terminal biotin will be oriented such that the C-terminal portion of the peptide will be distal to the surface.

EXAMPLES

The following examples are put forth so as to provide those of ordinary skill in the art with a complete disclosure and description of how to make and use the methods and compositions of the invention, and are not intended to limit the scope of what the inventors regard as their invention. Efforts have been made to ensure accuracy with respect to numbers used (e.g., amounts, temperature, etc.) but some experimental errors and deviations should be accounted for. Unless indicated otherwise, parts are parts by weight, molecular weight is average molecular weight, temperature is in degrees Centigrade, room temperature is about 25° C., and pressure is at or near atmospheric.

Example 1: Generation of Human Antibodies to Influenza HA

Human antibodies to influenza HA were generated in a VELOCIMMUNE® mouse comprising DNA encoding human immunoglobulin heavy and kappa light chain variable regions. The mice were immunized with an influenza vaccine composition, followed by a booster dose comprising a mixture of five different recombinant hemagglutinin proteins, at a 1:1 ratio of each. The five recombinant hemagglutinin proteins included in the booster were hemagglutinins from H1 A/New Caledonia/20/1999, H5 A/Indonesia/05/2005, H3 A/Victoria/361/2011, H7 A/Netherlands/219/2003 and H9 A/Hong Kong/1073/1988 (Protein Sciences, Catalog Number 3006). The antibody immune response was monitored by an influenza A HA specific immunoassay. When a desired immune response was achieved, splenocytes were harvested and fused with mouse myeloma cells to preserve their viability and form hybridoma cell lines. The hybridoma cell lines were screened and selected to identify cell lines that produce influenza HA-specific antibodies. Using this technique, and the various immunogens described above, several chimeric antibodies (i.e., antibodies possessing human variable domains and mouse constant domains) were obtained; exemplary antibodies generated in this manner were designated as H1H11820N, H1H11829N, H1H11829N2, H2M11830N, H1H11830N2, H1H11903N and H1H14571N.

Anti-influenza HA antibodies were also isolated directly from antigen-positive mouse B cells without fusion to myeloma cells, as described in U.S. Pat. No. 7,582,298, herein specifically incorporated by reference in its entirety. Using this method, several fully human anti-influenza HA antibodies (i.e., antibodies possessing human variable domains and human constant domains) were obtained; exemplary antibodies generated in this manner were designated as H1H11723P, H1H11729P, H1H11704P, H1H11711P, H1H11714P, H1H11717P, H1H11724P, H1H11727P, H1H11730P, H1H11731P2, H1H11734P2, H1H11736P2, H1H11742P2, H1H11744P2, H1H11745P2, H1H11747P2, H1H11748P2.

The biological properties of the exemplary antibodies generated in accordance with the methods of this Example are described in detail in the Examples set forth below.

Example 2: Heavy and Light Chain Variable Region Amino Acid and Nucleotide Sequences Table 1 sets forth the amino acid sequence identifiers of the heavy and light chain variable regions and CDRs of selected anti-influenza HA antibodies of the invention. The corresponding nucleic acid sequence identifiers are set forth in Table 2.

TABLE 1

Amino Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H11723P | 2 | 4 | 6 | 8 | 10 | 12 | 14 | 16 |
| H1H11729P | 18 | 20 | 22 | 24 | 26 | 28 | 30 | 32 |
| H1H11820N | 34 | 36 | 38 | 40 | 42 | 44 | 46 | 48 |
| H1H11829N | 50 | 52 | 54 | 56 | 58 | 60 | 62 | 64 |
| H1H11829N2 | 50 | 52 | 54 | 56 | 66 | 68 | 70 | 72 |
| H2aM11829N | 50 | 52 | 54 | 56 | 58 | 60 | 62 | 64 |
| H2M11830N | 74 | 76 | 78 | 80 | 82 | 84 | 86 | 88 |
| H1H11830N2 | 74 | 76 | 78 | 80 | 66 | 68 | 70 | 72 |
| H1H11903N | 90 | 92 | 94 | 96 | 98 | 100 | 102 | 104 |
| H1H14571N | 106 | 108 | 110 | 112 | 114 | 116 | 118 | 120 |
| H2a14571N | 106 | 108 | 110 | 112 | 114 | 116 | 118 | 120 |
| H1H11704P | 122 | 124 | 126 | 128 | 130 | 132 | 134 | 136 |
| H1H11711P | 138 | 140 | 142 | 144 | 146 | 148 | 150 | 152 |
| H1H11714P | 154 | 156 | 158 | 160 | 162 | 164 | 166 | 168 |
| H1H11717P | 170 | 172 | 174 | 176 | 178 | 180 | 182 | 184 |
| H1H11724P | 186 | 188 | 190 | 192 | 194 | 196 | 198 | 200 |
| H1H11727P | 202 | 204 | 206 | 208 | 210 | 212 | 214 | 216 |
| H1H11730P2 | 218 | 220 | 222 | 224 | 226 | 228 | 230 | 232 |
| H1H11731P2 | 234 | 236 | 238 | 240 | 66 | 68 | 70 | 72 |
| H1H11734P2 | 242 | 244 | 246 | 248 | 66 | 68 | 70 | 72 |
| H1H11736P2 | 250 | 252 | 254 | 256 | 66 | 68 | 70 | 72 |
| H1H11742P2 | 258 | 260 | 262 | 264 | 66 | 68 | 70 | 72 |
| H1H11744P2 | 266 | 268 | 270 | 272 | 66 | 68 | 70 | 72 |
| H1H11745P2 | 274 | 276 | 278 | 280 | 66 | 68 | 70 | 72 |
| H1H11747P2 | 282 | 284 | 286 | 288 | 66 | 68 | 70 | 72 |
| H1H11748P2 | 290 | 292 | 294 | 296 | 66 | 68 | 70 | 72 |

TABLE 2

Nucleic Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H11723P | 1 | 3 | 5 | 7 | 9 | 11 | 13 | 15 |
| H1H11729P | 17 | 19 | 21 | 23 | 25 | 27 | 29 | 31 |
| H1H11820N | 33 | 35 | 37 | 39 | 41 | 43 | 45 | 47 |
| H1H11829N | 49 | 51 | 53 | 55 | 57 | 59 | 61 | 63 |
| H1H11829N2 | 49 | 51 | 53 | 55 | 65 | 67 | 69 | 71 |
| H2aM11829N | 49 | 51 | 53 | 55 | 57 | 59 | 61 | 63 |
| H2M11830N | 73 | 75 | 77 | 79 | 81 | 83 | 85 | 87 |
| H1H11830N2 | 73 | 75 | 77 | 79 | 65 | 67 | 69 | 71 |
| H1H11903N | 89 | 91 | 93 | 95 | 97 | 99 | 101 | 103 |
| H1H14571N | 105 | 107 | 109 | 111 | 113 | 115 | 117 | 119 |
| H2a14571N | 105 | 107 | 109 | 111 | 113 | 115 | 117 | 119 |
| H1H11704P | 121 | 123 | 125 | 127 | 129 | 131 | 133 | 135 |
| H1H11711P | 137 | 139 | 141 | 143 | 145 | 147 | 149 | 151 |
| H1H11714P | 153 | 155 | 157 | 159 | 161 | 163 | 165 | 167 |
| H1H11717P | 169 | 171 | 173 | 175 | 177 | 179 | 181 | 183 |
| H1H11724P | 185 | 187 | 189 | 191 | 193 | 195 | 197 | 199 |
| H1H11727P | 201 | 203 | 205 | 207 | 209 | 211 | 213 | 215 |
| H1H11730P | 217 | 219 | 221 | 223 | 225 | 227 | 229 | 231 |
| H1H11731P2 | 233 | 235 | 237 | 239 | 65 | 67 | 69 | 71 |
| H1H11734P2 | 241 | 243 | 245 | 247 | 65 | 67 | 69 | 71 |
| H1H11736P2 | 249 | 251 | 253 | 255 | 65 | 67 | 69 | 71 |
| H1H11742P2 | 257 | 259 | 261 | 263 | 65 | 67 | 69 | 71 |
| H1H11744P2 | 265 | 267 | 269 | 271 | 65 | 67 | 69 | 71 |

TABLE 2-continued

| | Nucleic Acid Sequence Identifiers | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H1H11745P2 | 273 | 275 | 277 | 279 | 65 | 67 | 69 | 71 |
| H1H11747P2 | 281 | 283 | 285 | 287 | 65 | 67 | 69 | 71 |
| H1H11748P2 | 289 | 291 | 293 | 295 | 65 | 67 | 69 | 71 |

Antibodies are typically referred to herein according to the following nomenclature: Fc prefix (e.g. "H1H," "H2M," etc.), followed by a numerical identifier (e.g. "11723," "11830," etc., as shown in Table 1 or 2), followed by a "P," "P2," "N", N2, or "B" suffix. Thus, according to this nomenclature, an antibody may be referred to herein as, e.g., "H1H11723P," "H2M11830N," etc. The H1H and H2M prefixes on the antibody designations used herein indicate the particular Fc region isotype of the antibody. For example, an "H1M" antibody has a mouse IgG1 Fc, and an "H2M" antibody has a mouse IgG2 Fc (a or b isotype) (all variable regions are fully human as denoted by the first 'H' in the antibody designation). As will be appreciated by a person of ordinary skill in the art, an antibody having a particular Fc isotype can be converted to an antibody with a different Fc isotype (e.g., an antibody with a mouse IgG1 Fc can be converted to an antibody with a human IgG4, etc.), but in any event, the variable domains (including the CDRs)—which are indicated by the numerical identifiers shown in Tables 1, 2, 12 or 13—will remain the same, and the binding properties to antigen are expected to be identical or substantially similar regardless of the nature of the Fc domain.

Antibody Comparators

Anti-influenza-HA antibody controls were included in some of the following Examples for comparative purposes. Isotype matched negative controls were also used in the Examples. One anti-influenza HA comparator antibody, designated herein as "Control I mAb", is an anti-influenza HA antibody with heavy (HC) and light chain (LC) amino acid sequences as set forth in WO2008/028946 as SEQ ID NO: 65 (HC) and SEQ ID NO: 91 (LC) and also referred to as CR6261. As shown in WO2008/028946, this CR6261 antibody has heavy chain complementarity determining region (HCDR) amino acid sequences (HCDR 1, 2 and 3) as shown as SEQ ID NOs: 1, 2 and 3, respectively and light chain complementarity determining region (LCDR) amino acid sequences (LCDR1, 2 and 3) as shown in SEQ ID NOs: 13, 14 and 15, respectively.

Example 3: Octet Binding Affinities and Kinetic Constants of Monoclonal Anti-Influenza HA Antibodies Equilibrium dissociation constants ($K_D$ values) for Influenza hemagglutinin (HA) binding to selected purified anti-HA monoclonal antibodies were determined using a real-time bio-layer interferometer based biosensor (Octet HTX) assay. Octet biosensors coated with either anti-mouse Fc (AMC) or anti-human Fc (AHC) capture were used to capture anti-HA monoclonal antibodies, expressed with mouse Fc (AbPID prefix H1M, H2aM, H2bM) or human IgG1 Fc (AbPID prefix H1H) respectively. All the binding studies were performed in HBS-ET Octet kinetics buffer (10 mM HEPES pH 7.4, 0.15M NaCl, 3 mM EDTA, 0.05% v/v Surfactant Tween-20, 1 mg/mL BSA) at 25° C. with plates shaking at a speed of 1000 rpm. Antibody captured Octet biosensors were submerged in wells containing different concentrations of diverse strains of HA (300 nM to 11.11 nM) for 7 minutes followed by dissociation of antibody bound HA protein in Octet kinetics buffer for 10 minutes. Biosensors were always washed in Octet kinetics buffer in between different steps. Kinetic association ($k_a$) and dissociation ($k_d$) rate constants were determined by processing and fitting the data to a 1:1 binding model using Scrubber 2.0c curve fitting software. Binding dissociation equilibrium constants ($K_D$) and dissociative half-lives ($t\frac{1}{2}$) were calculated from the kinetic rate constants as:

$$K_D(M) = \frac{ka}{kd}, \text{ and } t1/2(\min) = \frac{\ln(2)}{60 \times kd}$$

Binding kinetics parameters for different anti-HA monoclonal antibodies binding to varying Group-1 strains of HA are tabulated in Table 3. In addition, the binding parameters for the same antibodies were determined for binding to group 2 hemagglutinins, however, there was no binding to group 2 HA (data not shown).

TABLE 3

Binding Kinetics parameters of monoclonal antibodies binding to different HA strains of Group-1 at 25° C.

| mAb Captured | Injected Analyte | Amount of mAb Captured (nm) | 300 nM HA Bound (nm) | $k_a$ (1/Ms) | $k_d$ (1/s) | $K_D$ (M) | $t\frac{1}{2}$ (min) |
|---|---|---|---|---|---|---|---|
| H2aM11829N | A/California/ 07/2009 (H1N1) | 0.53 ± 0.01 | 0.62 | 1.20E+05 | 1.00E−05* | 8.35E−11 | 1155* |
| | A/Puerto Rico/08/34 (H1N1) | 0.53 ± 0.01 | 0.59 | 1.09E+05 | 1.16E−05 | 1.06E−10 | 999 |

TABLE 3-continued

Binding Kinetics parameters of monoclonal antibodies
binding to different HA strains of Group-1 at 25° C.

| mAb Captured | Injected Analyte | Amount of mAb Captured (nm) | 300 nM HA Bound (nm) | $k_a$ (1/Ms) | $k_d$ (1/s) | $K_D$ (M) | $t\frac{1}{2}$ (min) |
|---|---|---|---|---|---|---|---|
| | A/Vietnam/1203/2004 (H5N1) | 0.52 ± 0.01 | 0.50 | 3.81E+04 | 1.99E−05 | 5.23E−10 | 580 |
| H1H11729P | A/California/07/2009 (H1N1) | 0.65 ± 0.01 | 0.84 | 7.35E+04 | 1.00E−05* | 1.36E−10 | 1155* |
| | A/Puerto Rico/08/34 (H1N1) | 0.67 ± 0.01 | 0.72 | 8.26E+04 | 1.00E−05* | 1.21E−10 | 1155* |
| | A/Vietnam/1203/2004 (H5N1) | 0.66 ± 0.01 | 0.62 | 1.99E+04 | 3.10E−05 | 1.56E−09 | 373 |
| H2aM14571N | A/California/07/2009 (H1N1) | 0.51 ± 0.01 | 0.58 | 1.05E+05 | 1.18E−05 | 1.12E−10 | 978 |
| | A/Puerto Rico/08/34 (H1N1) | 0.5 ± 0.02 | 0.46 | 6.80E+04 | 2.44E−05 | 3.59E−10 | 474 |
| | A/Vietnam/1203/2004 (H5N1) | 0.51 ± 0.01 | 0.31 | 1.14E+04 | 1.00E−05* | 8.77E−10 | 1155* |

Example 4: HA Octet Cross-Competition

Binding competition between a panel of different anti-influenza HA monoclonal antibodies was determined using a real time, label-free bio-layer interferometry assay on an Octet® HTX biosensor (ForteBio, A Division of Pall Life Sciences). The entire experiment was performed at 25° C. in 0.01M HEPES pH7.4, 0.15M NaCl, 0.05% v/v Surfactant Tween-20, and 1 mg/mL BSA (HBS-ET Octet buffer) with the plate shaking at a speed of 1000 rpm. To assess whether two antibodies were able to compete with one another for binding to their respective epitopes on HA, a pre-mix assay format was adopted. One Group-1 strain of HA protein (California) was used to study cross-competition between different anti-HA monoclonal antibodies. To achieve this, 100 nM of HA reagent (Protein Sciences) was first pre-mixed with 1 µM concentration of different anti-HA monoclonal antibodies (subsequently referred to as mAb-2) for at least 2 hours prior to running the binding competition assay. Octet biosensors coated with either an anti-mouse Fc polyclonal antibody (Pall ForteBio Corp., #18-5088; subsequently referred as AMC) or with an anti-human Fc polyclonal antibody (Pall ForteBio Corp., #18-5060; subsequently referred as AHC) were first submerged into wells containing 20 µg/mL solution of individual anti-HA monoclonal antibodies for 3 minutes to capture anti-HA monoclonal antibodies expressed either with a mouse Fc or with a human Fc, respectively (subsequently referred to as mAb-1). Following the capture step, unoccupied anti-mouse Fc polyclonal antibody and anti-human Fc polyclonal antibody on the Octet biosensors were saturated by submerging into wells containing 1 µM solution of a mixture of irrelevant monoclonal antibody expressed with different Fc (human IgG1, mouse IgG2a and mouse IgG2b) for 3 minutes. Finally, the Octet biosensors were immersed for 5 minutes into wells containing the pre-mixed samples of 100 nM of HA and 1 µM concentration of mAb-2. At the end of each cycle, the captured anti-HA monoclonal antibodies along with the bound pre-complex of HA and mAb-2 were regenerated using three alternate 20 second dips into 20 mM $H_3PO_4$ followed by submerging into HBS-ET Octet buffer. The biosensors were washed in HBS-ET Octet buffer in between every step of the experiment. The real-time binding response was monitored during the entire course of the experiment and the binding response at the end of every step was recorded. During the analysis, the self-self background binding signal (where mAb-1=mAb-2) caused due to the non-specific binding of anti-HA monoclonal antibody to the unoccupied capture surface was subtracted from the entire column and a cross-competition table was generated (Table 4). The response of mAb-1 binding to the pre-complex of HA and mAb-2 was compared and competitive/non-competitive behavior of different anti-HA monoclonal antibodies was determined.

As shown in Table 4, the column on the left shows the mAb1 antibodies that are captured using the AHC Octet biosensors and the column on the right demonstrates the antibodies (mAb2) that cross-compete with the mAb1 antibody.

TABLE 4

Cross-competition between a panel of different anti-HA monoclonal antibodies for binding to H1N1 California strain of HA

| First mAb (mAb-1) Captured using AHC Octet Biosensors | mAb-2 Antibodies Shown to Compete with mAb-1 |
|---|---|
| H2aM11829N | H2aM14571N |
| | H1H11729P |
| H2aM14571N | H2aM11829N |
| | H1H11729P |
| H1H11729P | H2aM11829N |
| | H2aM14571N |

Example 4: Selected Group 1-Specific Influenza A Hemagglutinin Monoclonal Antibodies Show Potent Neutralization of Influenza A In Vitro Across Diverse Group 1 Strains Cell Viability Microneutralization Assay Monoclonal antibodies were tested in a microneutralization assay to evaluate breadth and potency. In brief, Madin-Darby canine kidney (MDCK) cells were plated at $6.0 \times 10^3$ cells/well in a 96-well plate. Virus diluent only was added to background control wells. Cells were incubated for 4 to 5 hours at 37° C. with 5% $CO_2$. Monoclonal antibodies were diluted at 4 times final concentration in virus diluent. The antibodies were diluted 1:3 in duplicate. Virus was thawed on ice and diluted to the appropriate pre-determined concentration. Diluted virus was added to diluted mAbs. The mAb-virus mixture was immediately transferred to the MDCK cells and incubated at 37° C. with 5% $CO_2$ for 72 h. Virus control and uninfected cell control wells were also included. On day 4, the plates were centrifuged at 1200 RPM for 3 minutes. Cells were lysed using 100 µL CelTiter-Glo substrate and ATP release measured using luminescence (Victor X3, PerkinElmer). Percent viability was determined relative to uninfected control. Viability values were analyzed using non-linear 4PL regression to determine $IC_{50}$ values (GraphPad Prism).

The mAbs showed potency against a broad range of group 1 influenza A viruses (Table 5), including various H1N1, H5N1, H9N2, H13N6, and H16N3 strains. The $IC_{50}$ values ranged from 1.68 nM to 48 nM for H2aM11829N and from 2.47 nM to 129.5 nM for H1H11729P.

TABLE 5

Neutralization potency against various representative group 1 Influenza strains. (average of 3 to 5 runs shown)

| PID | $IC_{50}$ (nM) | | | | | | |
|---|---|---|---|---|---|---|---|
| | H1_PR34 | H1_WS33 | H1_IVR148 | H1_CA09 | H9_RG26 | H13_MD77 | H16_DE09 |
| H2aM11829N | 3.29 | 1.68 | 48.0 | 3.50 | 10.2 | 2.11 | 7.39 |
| H1H11729P | 2.82 | 2.47 | 129.5 | 4.54 | 14.9 | 33.8 | 21.6 |

Example 5. Selected Group 1-Specific Influenza A Hemagglutinin Monoclonal Antibodies Show Potent Neutralization of Influenza A In Vitro The exemplary monoclonal antibodies (mAb) H1H11829N2 and H1H11729P were selected for in vitro microneutralization assays. Briefly, Madin-Darby Canine Kidney (MDCK) cells were plated and incubated overnight to achieve 80-100% confluency the next day. Monoclonal antibodies were diluted in viral infection medium (VIM) to 50 µg/mL and diluted 1:2 in triplicate or quadruplicate. H5N1 A/Vietnam/1203/2004 or H1N1 A/California/07/2009 was diluted in VIM and added to the diluted antibodies and incubated for 1 h. The samples were then transferred to the MDCKs and incubated for 48 h. After the incubation, 50 µL of the supernatant was transferred to a new 96-well plate. Diluted turkey or horse red blood cells were added to the supernatant and incubated at room temperature for 30 or 60 min. The hemagglutination titer was recorded as the reciprocal of the last dilution that completely inhibited hemagglutination.

Exemplary antibodies H1H11829N2 and H1H11729P show potent neutralization of H5N1 A/Vietnam/1203/2004 and H1N1 A/California/07/2009 (Table 6). The average $IC_{90}$ values for exemplary antibodies H1H11829N2 and H1H11729P with respect to neutralization of H5N1 A/Vietnam/1203/2004 were on average 62.50 nM and 26.05 nM (respectively).

TABLE 6

Hemagglutinin titers after microneutralization assay with H5N1 A/Vietnam/1203/2004 and H1N1 A/California/07/2009 with selected group 1 hemagglutinin-specific antibodies. Shown are the $IC_{90}$ values (nM).

| Antibody Number | $IC_{90}$ (nM) H5N1 A/Vietnam/1203/2004 | | $IC_{90}$ (nM) H1N1 A/California/07/2009 |
|---|---|---|---|
| | Trial 1 | Trial 2 | Trial 1 |
| H1H11829N2 | 83.3 | 41.7 | 41.7 |
| H1H11729P | 41.7 | 10.4 | 83.3 |

Example 6. Complement-Dependent Cytotoxicity of Influenza Infected Cells In Vitro Using Influenza A Specific Monoclonal Antibodies The exemplary monoclonal antibodies (mAb) H1H11829N2 and H1H11729P were selected for in vitro complement-dependent cytotoxicity (CDC) assays. Briefly, Madin-Darby Canine Kidney (MDCK) cells were plated 24 hours prior to infection with H1N1 A/Puerto Rico/08/1934 at an MOI of 3. After an incubation of 20 to 25 hours, cells were harvested and resuspended in CDC assay medium at a concentration of $1 \times 10^6$ cells/mL. The diluted target cells (20 µL) were added to each well of a 384-well plate. Monoclonal antibodies were diluted to three times the final starting concentration in CDC assay medium and then diluted 1:2 in triplicate or quadruplicate. CDC assay medium was added to each well not receiving mAb. The plate was shaken at room temperature for ~2 min at ~500 rpm. Normal human serum complement (NHSC) was prepared at three times the final concentration (15%) in CDC assay medium and 20 µL was added to each well. The plate was incubated for 2 h at room temperature and the lysis reagent, buffer and substrate was brought to room temperature at this time. The lysis reagent was prepared by dilution of digitonin into CDC assay medium and 5 µL of this reagent was added to the maximal lysis control wells to establish the maximal signal control. The substrate and buffer were combined and 20 µL added to all wells and incubated for 10 min at room temperature. The signal was detected on a plate reader (Victor X3, Perkin Elmer). The percent specific lysis was calculated as ((lysis by mAb+NHSC)−(lysis by NHSC only))/((digitonin maximal lysis)−(lysis by NHSC only))×100. Analysis was completed by a four-parameter non-linear regression over an 8-point response curve (GraphPad Prism). Data was plotted for individual trials±standard deviation, and data presented as averages of all trails±standard error of the mean.

Exemplary antibodies H1H11829N2 and H1H11729P show potent complement-mediated lysis of infected cells. Three randomly selected trials are shown in Table 7. The average $EC_{50}$ values for exemplary antibodies H1H11829N2 and H1H11729P were on average 41.88 nM (±13.08 SEM) and H1H11729P were 43.25 nM (±3.83 SEM) respectively.

TABLE 7

Percent specific lysis of H1N1 A/Puerto Rico/08/1934-infected target cells by group 1 hemagglutinin-specific antibodies. Shown are the $EC_{50}$ values (nM) for each of three replicates.

| AbPID | $EC_{50}$ (nM) | | |
|---|---|---|---|
| | Trial 1 | Trial 2 | Trial 3 |
| H1H11829N2 | 65.94 | 38.75 | 20.94 |
| H1H11729P | 50.83 | 38.49 | 40.44 |
| hIgG1 irrelevant mAb | >333 | >333 | >333 |

Example 7: Selected Group 1-Specific Influenza A Hemagglutinin Monoclonal Antibodies Show Potent Neutralization of Influenza A Infection In Vivo Single Dose Prophylaxis Mouse Model The exemplary monoclonal antibodies H2aM11829N, H1H11729P and H2a14571N were selected for in vivo protection studies using BALB/c mice. Briefly, approximately 6-week old, female mice (approximately 17.5±0.5 g) were injected subcutaneously (SC) with 1 mg/kg of H2aM11829N, H1H11729P, H2a14571N, or mouse or human isotype (negative control) antibody on day −1. Five mice were included per group per experiment. Twenty-four hours post-injection (day 0), mice were challenged intranasally (IN) with $10 \times MLD_{50}$ (800 plaque forming units; PFUs) in 20 μL saline with H1N1 A/Puerto Rico/08/1934. Mice were weighed daily and were sacrificed when they lost >20% of their initial starting weight.

Exemplary antibodies H2aM11829N, H1H11729P and H2a14571N show potent neutralization of influenza A infection in vivo at 1 mg/kg.

Dose Response Prophylaxis Mouse Model

The exemplary monoclonal antibodies H1H11829N2 and H1H11729P were selected for prophylactic in vivo protection studies using BALB/c mice. Briefly, 6-week old, female mice (approximately 17.5±0.5 g) were injected SC with 1, 0.5, 0.1 or 0.05 mg/kg or 2, 0.5, 0.2 or 0.05 mg/kg of H1H11829N2, H1H11729P antibody on day −1. Five mice were included per group per experiment. Carrier protein (an irrelevant hIgG1 mAb) was added to all doses of mAb at 1 mg/mL. Twenty-four hours post-injection (day 0), mice were challenged intranasally with $10 \times MLD_{50}$ (800 plaque forming units; PFUs) in 20 μL saline with H1N1 A/Puerto Rico/08/1934 or $5 \times MLD_{50}$ (5,000 PFUs) in 20 μL saline with H1N1 A/California/04/2009. Mice were weighed daily and were sacrificed when they lost >20% of their initial starting weight.

When challenged with H1_PR34, exemplary antibodies H1H11829N2 and H1H11729P show potent neutralization of influenza A infection in vivo at 1 mg/kg. At 0.5 and 0.1 mg/kg, H1H11729P shows 100% and 40% survival, respectively. (Tables 8, 9 and 10). When challenged with H1_CA09, exemplary antibodies H1H11829N2 and H1H11729P show potent neutralization of influenza A infection in vivo at 2, 0.5 and 0.2 mg/kg and showed 60% survival at 0.05 mg/kg. (Tables 8, 9 and 10).

TABLE 8

Percent survival of mice in experiment 1 after administration of 1 mg/kg group 1 hemagglutinin-specific antibodies, SC prophylactically one day before infection with 10 x $MLD_{50}$ of H1N1 A/Puerto Rico/08/1934.

| PID | Number of mice per group | Percent survival (no. of surviving mice/total no. of mice in the group) |
|---|---|---|
| Saline (uninfected) | 5 | 100 (5/5) |
| H2aM11829N | 5 | 100 (5/5) |
| H1H11729P | 5 | 100 (5/5) |
| H2a14571N | ND | ND |
| hIgG1 isotype control | 5 | 0 (0/5) |
| mIgG2a isotype control | 5 | 0 (0/5) |

TABLE 9

Percent survival of mice in experiment 2 after administration of 1 mg/kg group 1 hemagglutinin-specific antibodies, SC prophylactically one day before infection with 10 x $MLD_{50}$ of H1N1 A/Puerto Rico/08/1934.

| PID | Number of mice per group | Percent survival (no. of surviving mice/total no. of mice in the group) |
|---|---|---|
| Saline (uninfected) | 5 | 100 (5/5) |
| H2aM11829N | 5 | 100 (5/5) |
| H1H11729P | 5 | 100 (5/5) |
| H2a14571N | 5 | 100 (5/5) |

TABLE 10

Percent survival of mice after administration of 1, 0.5, 0.1 or 0.05 mg/kg group 1 hemagglutinin-specific antibodies, SC prophylactically one day before infection with 10 x $MLD_{50}$ of H1N1 A/Puerto Rico/08/1934 or 2, 0.5, 0.2 or 0.05 mg/kg, SC prophylactically one day before infection with 5 x $MLD_{50}$ of H1N1 A/California/04/2009.

| PID | Challenge virus: H1N1 A/Puerto Rico/08/1934 | | | Challenge virus: H1N1 A/California/04/2009 | | |
|---|---|---|---|---|---|---|
| | Dose of mAb (mg/kg) | Number of mice per group | Percent survival (no. of surviving mice/total no. of mice in the group) | Dose of mAb (mg/kg) | Number of mice per group | Percent survival (no. of surviving mice/total no. of mice in the group) |
| Saline with carrier protein (uninfected) | N/A | 5 | 100 (5/5) | N/A | 5 | 100 (5/5) |

TABLE 10-continued

Percent survival of mice after administration of 1, 0.5, 0.1 or 0.05 mg/kg group 1 hemagglutinin-specific antibodies, SC prophylactically one day before infection with 10 x MLD$_{50}$ of H1N1 A/Puerto Rico/08/1934 or 2, 0.5, 0.2 or 0.05 mg/kg, SC prophylactically one day before infection with 5 x MLD$_{50}$ of H1N1 A/California/04/2009.

| | Challenge virus: H1N1 A/Puerto Rico/08/1934 | | | Challenge virus: H1N1 A/California/04/2009 | | |
|---|---|---|---|---|---|---|
| PID | Dose of mAb (mg/kg) | Number of mice per group | Percent survival (no. of surviving mice/total no. of mice in the group) | Dose of mAb (mg/kg) | Number of mice per group | Percent survival (no. of surviving mice/total no. of mice in the group) |
| H1H11829N2 | 1 | 5 | 100 (5/5) | 2 | 5 | 100 (5/5) |
|  | 0.5 |  | 60 (3/5) | 0.5 |  | 100 (5/5) |
|  | 0.1 |  | 0 (0/5) | 0.2 |  | 100 (5/5) |
|  | 0.05 |  | 20 (1/5) | 0.05 |  | ND |
| H1H11729P | 1 | 5 | 100 (5/5) | 2 | 5 | 100 (5/5) |
|  | 0.5 |  | 100 (5/5) | 0.5 |  | 100 (5/5) |
|  | 0.1 |  | 40 (2/5) | 0.2 |  | 100 (5/5) |
|  | 0.05 |  | 0 (0/5) | 0.05 |  | 60 (3/5) |

Dose Response Therapeutic Mouse Model

The exemplary monoclonal antibodies H1H11829N2 and H1H11729P were selected for therapeutic in vivo protection studies using BALB/c mice. Briefly, 6-week old, female mice (approximately 17.5±0.5 g) were infected intranasally with 10×MLD$_{50}$ (800 plaque forming units; PFUs) in 20 µL saline with H1N1 A/Puerto Rico/08/1934 or 5×MLD$_{50}$ (5,000 PFUs) in 20 µL saline with H1N1 A/California/04/2009. Three, four or five days (in the case of H1_PR34) or one, two or three days (in the case of H1_CA09) post-infection, separate groups of 5 mice were injected IV with 15 mg/kg or 30 mg/kg of H1H11829N2, or H1H11729P antibody. Mice were weighed daily and were sacrificed when they lost >20% of their initial starting weight.

When challenged with both a historical and contemporary H1N1 virus strain, exemplary antibodies H1H11829N2 and H1H11729P show potent neutralization of influenza A infection in vivo. (Table 11).

TABLE 11

Percent survival of mice in a therapeutic model of infection. Mice were infected with 10 x MLD$_{50}$ of H1N1 A/Puerto Rico/08/1934 or 5 x MLD$_{50}$ of H1N1 A/California/04/2009 on day 0. On days 3, 4 or 5 (for H1N1 A/Puerto Rico/08/1934) or days 1, 2 or 3 (for H1N1 A/California/04/2009) mice antibodies were administered at 15 or 30 mg/kg, IV.

| | Challenge virus: H1N1 A/Puerto Rico/08/1934 (15 mg/kg mAb) | | | Challenge virus: H1N1 A/California/04/2009 (30 mg/kg mAb) | | |
|---|---|---|---|---|---|---|
| PID | Days post-infection | Number of mice per group | Percent survival (no. of surviving mice/total no. of mice in the group) | Days post-infection | Number of mice per group | Percent survival (no. of surviving mice/total no. of mice in the group) |
| H1H11829N2 | 3 | 5 | 40 (2/5) | 1 | 5 | 100 (5/5) |
|  | 4 |  | ND | 2 |  | 0 (0/5) |
|  | 5 |  | ND | 3 |  | 20 (1/5) |
| H1H11729P | 3 | 5 | 60 (3/5) | 1 | 5 | 100 (5/5) |
|  | 4 |  | 0 (0/5) | 2 |  | 0 (0/5) |
|  | 5 |  | 0 (0/5) | 3 |  | 20 (1/5) |

Example 8. Selected Group 1-Specific Influenza A Hemagglutinin Monoclonal Antibodies are Generated after Immunization with H5 Immunogens Additional human antibodies to Influenza A-HA were generated in VELOCIMMUNE® mice comprising DNA encoding human immunoglobulin heavy and kappa light chain variable regions. Naïve mice were divided into four groups. Groups 1 and 2 were immunized with trivalent influenza vaccine (TIV) Afluria® 2013-2014 formulation (NDC 3332-110-10). Groups 3 and 4 were left unimmunized. Approximately, four weeks later, groups 1 and 3 were injected intramuscularly with 50 µg H5 DNA (VRC9123 encoding H5 A/Indonesia/05/2005 (see Ledgerwood et al. (2011) *Lancet Infect. Dis.* 11: 916-924; Khurana et al. (2013) *J. Infect. Dis.* 208:413-417; Ledgerwood et al. (2013) *J. Infect. Dis.* 208: 418-422) and groups 2 and 4 were injected intramuscularly with 5 µg H5 monovalent influenza vaccine (MIV; VRC310 containing H5 A/Indonesia/05/2005) (see Ledgerwood et al. (2011) *Lancet Infect. Dis.* 11: 916-924, Khurana et al. (2013) *J. Infect. Dis.* 208:413-417; Ledgerwood et al. (2013) *J. Infect. Dis.* 208: 418-422). Approximately four weeks later, all 4 groups were immunized with 5 µg of H5 monovalent influenza vaccine (MIV; VRC310 containing H5 A/Indonesia/05/2005).

Anti-influenza A-HA antibodies were isolated directly from receptor-binding site (RBS) mutated, avi-tagged H5 A/Indonesia/05/2005 and/or H1 A/New Caledonia/20/1999 that contained a carboxy-terminal trimerization domain from T4 phage fibritin (foldon)-positive mouse B cells without fusion to myeloma cells, as described in U.S. Pat. No. 7,582,298, herein specifically incorporated by reference in its entirety. Using this method, several additional fully human anti-influenza A-HA antibodies (i.e., antibodies possessing human variable domains and human constant domains) were obtained; exemplary antibodies generated in this manner can be found in Tables 12 (amino acid sequence identifiers) and 13 (nucleic acid sequence identifiers) below. The samples were evaluated for binding to receptor-binding site (RBS) mutated, foldon, avi-tagged H5 and H1 via Luminex. As expected, all but 16 samples bound to H5 protein with mean fluorescent intensities (MFI) of greater than 15,000. However, for the most part, samples that also bound to H1 protein had high binding to H5 (i.e., greater than 15,000 MFI). Two groups of monoclonal antibodies were observed; those which bound to H1 with greater than 15,000 MFI (20 samples) and those that bound to H5 with greater than 5000 MFI (44 samples).

TABLE 12

| Amino Acid Sequence Identifiers<br>Amino Acid SEQ ID NOs: | | | | | | | | |
|---|---|---|---|---|---|---|---|---|
| Antibody Designation | HCVR | HCDR1 | HCDR2 | HCDR3 | LCVR | LCDR1 | LCDR2 | LCDR3 |
| H1H17952B | 298 | 300 | 302 | 304 | 306 | 308 | 310 | 312 |
| H1H17953B | 314 | 316 | 318 | 320 | 322 | 324 | 326 | 328 |
| H1H17954B | 330 | 332 | 334 | 336 | 338 | 340 | 342 | 344 |
| H1H17955B | 346 | 348 | 350 | 352 | 354 | 356 | 358 | 360 |
| H1H17956B | 362 | 364 | 366 | 368 | 370 | 372 | 374 | 376 |
| H1H17957B | 378 | 380 | 382 | 384 | 386 | 388 | 390 | 392 |
| H1H17958B | 394 | 396 | 398 | 400 | 402 | 404 | 406 | 408 |
| H1H17959B | 410 | 412 | 414 | 416 | 418 | 420 | 422 | 424 |
| H1H17960B | 426 | 428 | 430 | 432 | 434 | 436 | 438 | 440 |
| H1H17961B | 442 | 444 | 446 | 448 | 450 | 452 | 454 | 456 |
| H1H17962B | 458 | 460 | 462 | 464 | 466 | 468 | 470 | 472 |
| H1H17963B | 474 | 476 | 478 | 480 | 482 | 484 | 486 | 488 |
| H1H17964B | 490 | 492 | 494 | 496 | 498 | 500 | 502 | 504 |
| H1H17965B | 506 | 508 | 510 | 512 | 514 | 516 | 518 | 520 |
| H1H17966B | 522 | 524 | 526 | 528 | 530 | 532 | 534 | 536 |
| H1H17967B | 538 | 540 | 542 | 544 | 546 | 548 | 550 | 552 |
| H1H17968B | 554 | 556 | 558 | 560 | 562 | 564 | 566 | 568 |
| H1H17969B | 570 | 572 | 574 | 576 | 578 | 580 | 582 | 584 |
| H1H17970B | 586 | 588 | 590 | 592 | 594 | 596 | 598 | 600 |
| H1H17971B | 602 | 604 | 606 | 608 | 610 | 612 | 614 | 616 |
| H1H17972B | 618 | 620 | 622 | 624 | 626 | 628 | 630 | 632 |
| H1H17973B | 634 | 636 | 638 | 640 | 642 | 644 | 646 | 648 |
| H1H17974B | 650 | 652 | 654 | 656 | 658 | 660 | 662 | 664 |
| H1H17975B | 666 | 668 | 670 | 672 | 674 | 676 | 678 | 680 |
| H1H17976B | 682 | 684 | 686 | 688 | 690 | 692 | 694 | 696 |
| H1H17977B | 698 | 700 | 702 | 704 | 706 | 708 | 710 | 712 |
| H1H17978B | 714 | 716 | 718 | 720 | 722 | 724 | 726 | 728 |
| H1H17979B | 730 | 732 | 734 | 736 | 738 | 740 | 742 | 744 |
| H1H17980B | 746 | 748 | 750 | 752 | 754 | 756 | 758 | 760 |
| H1H17981B | 762 | 764 | 766 | 768 | 770 | 772 | 774 | 776 |
| H1H17982B | 778 | 780 | 782 | 784 | 786 | 788 | 790 | 792 |
| H1H17983B | 794 | 796 | 798 | 800 | 802 | 804 | 806 | 808 |
| H1H17984B | 810 | 812 | 814 | 816 | 818 | 820 | 822 | 824 |
| H1H17985B | 826 | 828 | 830 | 832 | 834 | 836 | 838 | 840 |
| H1H17986B | 842 | 844 | 846 | 848 | 850 | 852 | 854 | 856 |
| H1H17987B | 858 | 860 | 862 | 864 | 866 | 868 | 870 | 872 |
| H1H17988B | 874 | 876 | 878 | 880 | 882 | 884 | 886 | 888 |
| H1H17989B | 890 | 892 | 894 | 896 | 898 | 900 | 902 | 904 |
| H1H17990B | 906 | 908 | 910 | 912 | 914 | 916 | 918 | 920 |
| H1H17991B | 922 | 924 | 926 | 928 | 930 | 932 | 934 | 936 |
| H1H17992B | 938 | 940 | 942 | 944 | 946 | 948 | 950 | 952 |
| H1H17993B | 954 | 956 | 958 | 960 | 962 | 964 | 966 | 968 |
| H1H17994B | 970 | 972 | 974 | 976 | 978 | 980 | 982 | 984 |
| H1H17995B | 986 | 988 | 990 | 992 | 994 | 996 | 998 | 1000 |
| H1H17996B | 1002 | 1004 | 1006 | 1008 | 1010 | 1012 | 1014 | 1016 |
| H1H17997B | 1018 | 1020 | 1022 | 1024 | 1026 | 1028 | 1030 | 1032 |
| H1H17998B | 1034 | 1036 | 1038 | 1040 | 1042 | 1044 | 1046 | 1048 |
| H1H17999B | 1050 | 1052 | 1054 | 1056 | 1058 | 1060 | 1062 | 1064 |
| H1H18000B | 1066 | 1068 | 1070 | 1072 | 1074 | 1076 | 1078 | 1080 |
| H1H18001B | 1082 | 1084 | 1086 | 1088 | 1090 | 1092 | 1094 | 1096 |
| H1H18002B | 1098 | 1100 | 1102 | 1104 | 1106 | 1108 | 1110 | 1112 |
| H1H18003B | 1114 | 1116 | 1118 | 1120 | 1122 | 1124 | 1126 | 1128 |
| H1H18004B | 1130 | 1132 | 1134 | 1136 | 1138 | 1140 | 1142 | 1144 |
| H1H18005B | 1146 | 1148 | 1150 | 1152 | 1154 | 1156 | 1158 | 1160 |
| H1H18006B | 1162 | 1164 | 1166 | 1168 | 1170 | 1172 | 1174 | 1176 |
| H1H18007B | 1178 | 1180 | 1182 | 1184 | 1186 | 1188 | 1190 | 1192 |
| H1H18008B | 1194 | 1196 | 1198 | 1200 | 1202 | 1204 | 1206 | 1208 |
| H1H18009B | 1210 | 1212 | 1214 | 1216 | 1218 | 1220 | 1222 | 1224 |
| H1H18010B | 1226 | 1228 | 1230 | 1232 | 1234 | 1236 | 1238 | 1240 |
| H1H18011B | 1242 | 1244 | 1246 | 1248 | 1250 | 1252 | 1254 | 1256 |
| H1H18012B | 1258 | 1260 | 1262 | 1264 | 1266 | 1268 | 1270 | 1272 |
| H1H18013B | 1274 | 1276 | 1278 | 1280 | 1282 | 1284 | 1286 | 1288 |

TABLE 12-continued Amino Acid Sequence Identifiers
Amino Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H18014B | 1290 | 1292 | 1294 | 1296 | 1298 | 1300 | 1302 | 1304 |
| H1H18015B | 1306 | 1308 | 1310 | 1312 | 1314 | 1316 | 1318 | 1320 |
| H1H18016B | 1322 | 1324 | 1326 | 1328 | 1330 | 1332 | 1334 | 1336 |
| H1H18017B | 1338 | 1340 | 1342 | 1344 | 1346 | 1348 | 1350 | 1352 |
| H1H18018B | 1354 | 1356 | 1358 | 1360 | 1362 | 1364 | 1366 | 1368 |
| H1H18019B | 1370 | 1372 | 1374 | 1376 | 1378 | 1380 | 1382 | 1384 |
| H1H18020B | 1386 | 1388 | 1390 | 1392 | 1394 | 1396 | 1398 | 1400 |
| H1H18021B | 1402 | 1404 | 1406 | 1408 | 1410 | 1412 | 1414 | 1416 |
| H1H18022B | 1418 | 1420 | 1422 | 1424 | 1426 | 1428 | 1430 | 1432 |
| H1H18023B | 1434 | 1436 | 1438 | 1440 | 1442 | 1444 | 1446 | 1448 |
| H1H18024B | 1450 | 1452 | 1454 | 1456 | 1458 | 1460 | 1462 | 1464 |
| H1H18025B | 1466 | 1468 | 1470 | 1472 | 1474 | 1476 | 1478 | 1480 |
| H1H18026B | 1482 | 1484 | 1486 | 1488 | 1490 | 1492 | 1494 | 1496 |
| H1H18027B | 1498 | 1500 | 1502 | 1504 | 1506 | 1508 | 1510 | 1512 |
| H1H18028B | 1514 | 1516 | 1518 | 1520 | 1522 | 1524 | 1526 | 1528 |
| H1H18029B | 1530 | 1532 | 1534 | 1536 | 1538 | 1540 | 1542 | 1544 |
| H1H18030B | 1546 | 1548 | 1550 | 1552 | 1554 | 1556 | 1558 | 1560 |
| H1H18031B | 1562 | 1564 | 1566 | 1568 | 1570 | 1572 | 1574 | 1576 |
| H1H18032B | 1578 | 1580 | 1582 | 1584 | 1586 | 1588 | 1590 | 1592 |
| H1H18033B | 1594 | 1596 | 1598 | 1600 | 1602 | 1604 | 1606 | 1608 |
| H1H18034B | 1610 | 1612 | 1614 | 1616 | 1618 | 1620 | 1622 | 1624 |
| H1H18035B | 1626 | 1628 | 1630 | 1632 | 1634 | 1636 | 1638 | 1640 |
| H1H18037B | 1642 | 1644 | 1646 | 1648 | 1650 | 1652 | 1654 | 1656 |
| H1H18038B | 1658 | 1660 | 1662 | 1664 | 1666 | 1668 | 1670 | 1672 |
| H1H18039B | 1674 | 1676 | 1678 | 1680 | 1682 | 1684 | 1686 | 1688 |
| H1H18040B | 1690 | 1692 | 1694 | 1696 | 1698 | 1700 | 1702 | 1704 |
| H1H18041B | 1706 | 1708 | 1710 | 1712 | 1714 | 1716 | 1718 | 1720 |
| H1H18042B | 1722 | 1724 | 1726 | 1728 | 1730 | 1732 | 1734 | 1736 |
| H1H18043B | 1738 | 1740 | 1742 | 1744 | 1746 | 1748 | 1750 | 1752 |
| H1H18044B | 1754 | 1756 | 1758 | 1760 | 1762 | 1764 | 1766 | 1768 |
| H1H18045B | 1770 | 1772 | 1774 | 1776 | 1778 | 1780 | 1782 | 1784 |
| H1H18046B | 1786 | 1788 | 1790 | 1792 | 1794 | 1796 | 1798 | 1800 |
| H1H18047B | 1802 | 1804 | 1806 | 1808 | 1810 | 1812 | 1814 | 1816 |
| H1H18048B | 1818 | 1820 | 1822 | 1824 | 1826 | 1828 | 1830 | 1832 |
| H1H18049B | 1834 | 1836 | 1838 | 1840 | 1842 | 1844 | 1846 | 1848 |
| H1H18051B | 1850 | 1852 | 1854 | 1856 | 1858 | 1860 | 1862 | 1864 |
| H1H18052B | 1866 | 1868 | 1870 | 1872 | 1874 | 1876 | 1878 | 1880 |
| H1H18053B | 1882 | 1884 | 1886 | 1888 | 1890 | 1892 | 1894 | 1896 |
| H1H18054B | 1898 | 1900 | 1902 | 1904 | 1906 | 1908 | 1910 | 1912 |
| H1H18055B | 1914 | 1916 | 1918 | 1920 | 1922 | 1924 | 1926 | 1928 |
| H1H18056B | 1930 | 1932 | 1934 | 1936 | 1938 | 1940 | 1942 | 1944 |
| H1H18057B | 1946 | 1948 | 1950 | 1952 | 1954 | 1956 | 1958 | 1960 |
| H1H18058B | 1962 | 1964 | 1966 | 1968 | 1970 | 1972 | 1974 | 1976 |
| H1H18059B | 1978 | 1980 | 1982 | 1984 | 1986 | 1988 | 1990 | 1992 |
| H1H18060B | 1994 | 1996 | 1998 | 2000 | 2002 | 2004 | 2006 | 2008 |
| H1H18061B | 2010 | 2012 | 2014 | 2016 | 2018 | 2020 | 2022 | 2024 |
| H1H18062B | 2026 | 2028 | 2030 | 2032 | 2034 | 2036 | 2038 | 2040 |
| H1H18063B | 2042 | 2044 | 2046 | 2048 | 2050 | 2052 | 2054 | 2056 |
| H1H18064B | 2058 | 2060 | 2062 | 2064 | 2066 | 2068 | 2070 | 2072 |
| H1H18065B | 2074 | 2076 | 2078 | 2080 | 2082 | 2084 | 2086 | 2088 |
| H1H18066B | 2090 | 2092 | 2094 | 2096 | 2098 | 2100 | 2102 | 2104 |
| H1H18067B | 2106 | 2108 | 2110 | 2112 | 2114 | 2116 | 2118 | 2120 |
| H1H18068B | 2122 | 2124 | 2126 | 2128 | 2130 | 2132 | 2134 | 2136 |
| H1H18069B | 2138 | 2140 | 2142 | 2144 | 2146 | 2148 | 2150 | 2152 |
| H1H18070B | 2154 | 2156 | 2158 | 2160 | 2162 | 2164 | 2166 | 2168 |
| H1H18071B | 2170 | 2172 | 2174 | 2176 | 2178 | 2180 | 2182 | 2184 |
| H1H18072B | 2186 | 2188 | 2190 | 2192 | 2194 | 2196 | 2198 | 2200 |
| H1H18073B | 2202 | 2204 | 2206 | 2208 | 2210 | 2212 | 2214 | 2216 |
| H1H18074B | 2218 | 2220 | 2222 | 2224 | 2226 | 2228 | 2230 | 2232 |
| H1H18075B | 2234 | 2236 | 2238 | 2240 | 2242 | 2244 | 2246 | 2248 |
| H1H18076B | 2250 | 2252 | 2254 | 2256 | 2258 | 2260 | 2262 | 2264 |
| H1H18077B | 2266 | 2268 | 2270 | 2272 | 2274 | 2276 | 2278 | 2280 |
| H1H18078B | 2282 | 2284 | 2286 | 2288 | 2290 | 2292 | 2294 | 2296 |
| H1H18079B | 2298 | 2300 | 2302 | 2304 | 2306 | 2308 | 2310 | 2312 |
| H1H18080B | 2314 | 2316 | 2318 | 2320 | 2322 | 2324 | 2326 | 2328 |
| H1H18081B | 2330 | 2332 | 2334 | 2336 | 2338 | 2340 | 2342 | 2344 |
| H1H18082B | 2346 | 2348 | 2350 | 2352 | 2354 | 2356 | 2358 | 2360 |
| H1H18083B | 2362 | 2364 | 2366 | 2368 | 2370 | 2372 | 2374 | 2376 |
| H1H18084B | 2378 | 2380 | 2382 | 2384 | 2386 | 2388 | 2390 | 2392 |
| H1H18085B | 2394 | 2396 | 2398 | 2400 | 2402 | 2404 | 2406 | 2408 |
| H1H18086B | 2410 | 2412 | 2414 | 2416 | 2418 | 2420 | 2422 | 2424 |
| H1H18087B | 2426 | 2428 | 2430 | 2432 | 2434 | 2436 | 2438 | 2440 |
| H1H18088B | 2442 | 2444 | 2446 | 2448 | 2450 | 2452 | 2454 | 2456 |
| H1H18089B | 2458 | 2460 | 2462 | 2464 | 2466 | 2468 | 2470 | 2472 |

TABLE 12-continued

Amino Acid Sequence Identifiers
Amino Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H18090B | 2474 | 2476 | 2478 | 2480 | 2482 | 2484 | 2486 | 2488 |
| H1H18091B | 2490 | 2492 | 2494 | 2496 | 2498 | 2500 | 2502 | 2504 |
| H1H18092B | 2506 | 2508 | 2510 | 2512 | 2514 | 2516 | 2518 | 2520 |
| H1H18093B | 2522 | 2524 | 2526 | 2528 | 2530 | 2532 | 2534 | 2536 |
| H1H18094B | 2538 | 2540 | 2542 | 2544 | 2546 | 2548 | 2550 | 2552 |
| H1H18095B | 2554 | 2556 | 2558 | 2560 | 2562 | 2564 | 2566 | 2568 |
| H1H18096B | 2570 | 2572 | 2574 | 2576 | 2578 | 2580 | 2582 | 2584 |
| H1H18097B | 2586 | 2588 | 2590 | 2592 | 2594 | 2596 | 2598 | 2600 |
| H1H18098B | 2602 | 2604 | 2606 | 2608 | 2610 | 2612 | 2614 | 2616 |
| H1H18099B | 2618 | 2620 | 2622 | 2624 | 2626 | 2628 | 2630 | 2632 |
| H1H18100B | 2634 | 2636 | 2638 | 2640 | 2642 | 2644 | 2646 | 2648 |
| H1H18101B | 2650 | 2652 | 2654 | 2656 | 2658 | 2660 | 2662 | 2664 |
| H1H18102B | 2666 | 2668 | 2670 | 2672 | 2674 | 2676 | 2678 | 2680 |
| H1H18103B | 2682 | 2684 | 2686 | 2688 | 2690 | 2692 | 2694 | 2696 |
| H1H18104B | 2698 | 2700 | 2702 | 2704 | 2706 | 2708 | 2710 | 2712 |
| H1H18105B | 2714 | 2716 | 2718 | 2720 | 2722 | 2724 | 2726 | 2728 |
| H1H18107B | 2730 | 2732 | 2734 | 2736 | 2738 | 2740 | 2742 | 2744 |
| H1H18108B | 2746 | 2748 | 2750 | 2752 | 2754 | 2756 | 2758 | 2760 |
| H1H18109B | 2762 | 2764 | 2766 | 2768 | 2770 | 2772 | 2774 | 2776 |
| H1H18110B | 2778 | 2780 | 2782 | 2784 | 2786 | 2788 | 2790 | 2792 |
| H1H18111B | 2794 | 2796 | 2798 | 2800 | 2802 | 2804 | 2806 | 2808 |
| H1H18112B | 2810 | 2812 | 2814 | 2816 | 2818 | 2820 | 2822 | 2824 |
| H1H18113B | 2826 | 2828 | 2830 | 2832 | 2834 | 2836 | 2838 | 2840 |
| H1H18114B | 2842 | 2844 | 2846 | 2848 | 2850 | 2852 | 2854 | 2856 |
| H1H18115B | 2858 | 2860 | 2862 | 2864 | 2866 | 2868 | 2870 | 2872 |
| H1H18116B | 2874 | 2876 | 2878 | 2880 | 2882 | 2884 | 2886 | 2888 |
| H1H18117B | 2890 | 2892 | 2894 | 2896 | 2898 | 2900 | 2902 | 2904 |
| H1H18118B | 2906 | 2908 | 2910 | 2912 | 2914 | 2916 | 2918 | 2920 |
| H1H18119B | 2922 | 2924 | 2926 | 2928 | 2930 | 2932 | 2934 | 2936 |
| H1H18120B | 2938 | 2940 | 2942 | 2944 | 2946 | 2948 | 2950 | 2952 |
| H1H18121B | 2954 | 2956 | 2958 | 2960 | 2962 | 2964 | 2966 | 2968 |
| H1H18122B | 2970 | 2972 | 2974 | 2976 | 2978 | 2980 | 2982 | 2984 |
| H1H18123B | 2986 | 2988 | 2990 | 2992 | 2994 | 2996 | 2998 | 3000 |
| H1H18124B | 3002 | 3004 | 3006 | 3008 | 3010 | 3012 | 3014 | 3016 |
| H1H18125B | 3018 | 3020 | 3022 | 3024 | 3026 | 3028 | 3030 | 3032 |
| H1H18126B | 3034 | 3036 | 3038 | 3040 | 3042 | 3044 | 3046 | 3048 |
| H1H18127B | 3050 | 3052 | 3054 | 3056 | 3058 | 3060 | 3062 | 3064 |
| H1H18128B | 3066 | 3068 | 3070 | 3072 | 3074 | 3076 | 3078 | 3080 |
| H1H18129B | 3082 | 3084 | 3086 | 3088 | 3090 | 3092 | 3094 | 3096 |
| H1H18130B | 3098 | 3100 | 3102 | 3104 | 3106 | 3108 | 3110 | 3112 |
| H1H18131B | 3114 | 3116 | 3118 | 3120 | 3122 | 3124 | 3126 | 3128 |
| H1H18132B | 3130 | 3132 | 3134 | 3136 | 3138 | 3140 | 3142 | 3144 |
| H1H18133B | 3146 | 3148 | 3150 | 3152 | 3154 | 3156 | 3158 | 3160 |
| H1H18134B | 3162 | 3164 | 3166 | 3168 | 3170 | 3172 | 3174 | 3176 |
| H1H18135B | 3178 | 3180 | 3182 | 3184 | 3186 | 3188 | 3190 | 3192 |
| H1H18136B | 3194 | 3196 | 3198 | 3200 | 3202 | 3204 | 3206 | 3208 |
| H1H18137B | 3210 | 3212 | 3214 | 3216 | 3218 | 3220 | 3222 | 3224 |
| H1H18138B | 3226 | 3228 | 3230 | 3232 | 3234 | 3236 | 3238 | 3240 |
| H1H18139B | 3242 | 3244 | 3246 | 3248 | 3250 | 3252 | 3254 | 3256 |
| H1H18140B | 3258 | 3260 | 3262 | 3264 | 3266 | 3268 | 3270 | 3272 |
| H1H18141B | 3274 | 3276 | 3278 | 3280 | 3282 | 3284 | 3286 | 3288 |
| H1H18142B | 3290 | 3292 | 3294 | 3296 | 3298 | 3300 | 3302 | 3304 |
| H1H18143B | 3306 | 3308 | 3310 | 3312 | 3314 | 3316 | 3318 | 3320 |
| H1H18144B | 3322 | 3324 | 3326 | 3328 | 3330 | 3332 | 3334 | 3336 |
| H1H18145B | 3338 | 3340 | 3342 | 3344 | 3346 | 3348 | 3350 | 3352 |
| H1H18146B | 3354 | 3356 | 3358 | 3360 | 3362 | 3364 | 3366 | 3368 |
| H1H18147B | 3370 | 3372 | 3374 | 3376 | 3378 | 3380 | 3382 | 3384 |
| H1H18148B | 3386 | 3388 | 3390 | 3392 | 3394 | 3396 | 3398 | 3400 |
| H1H18149B | 3402 | 3404 | 3406 | 3408 | 3410 | 3412 | 3414 | 3416 |
| H1H18150B | 3418 | 3420 | 3422 | 3424 | 3426 | 3428 | 3430 | 3432 |
| H1H18151B | 3434 | 3436 | 3438 | 3440 | 3442 | 3444 | 3446 | 3448 |
| H1H18152B | 3450 | 3452 | 3454 | 3456 | 3458 | 3460 | 3462 | 3464 |
| H1H18153B | 3466 | 3468 | 3470 | 3472 | 3474 | 3476 | 3478 | 3480 |
| H1H18154B | 3482 | 3484 | 3486 | 3488 | 3490 | 3492 | 3494 | 3496 |
| H1H18155B | 3498 | 3500 | 3502 | 3504 | 3506 | 3508 | 3510 | 3512 |
| H1H18156B | 3514 | 3516 | 3518 | 3520 | 3522 | 3524 | 3526 | 3528 |
| H1H18157B | 3530 | 3532 | 3534 | 3536 | 3538 | 3540 | 3542 | 3544 |
| H1H18158B | 3546 | 3548 | 3550 | 3552 | 3554 | 3556 | 3558 | 3560 |
| H1H18159B | 3562 | 3564 | 3566 | 3568 | 3570 | 3572 | 3574 | 3576 |
| H1H18160B | 3578 | 3580 | 3582 | 3584 | 3586 | 3588 | 3590 | 3592 |
| H1H18161B | 3594 | 3596 | 3598 | 3600 | 3602 | 3604 | 3606 | 3608 |
| H1H18162B | 3610 | 3612 | 3614 | 3616 | 3618 | 3620 | 3622 | 3624 |
| H1H18163B | 3626 | 3628 | 3630 | 3632 | 3634 | 3636 | 3638 | 3640 |
| H1H18164B | 3642 | 3644 | 3646 | 3648 | 3650 | 3652 | 3654 | 3656 |

TABLE 12-continued

Amino Acid Sequence Identifiers
Amino Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H18165B | 3658 | 3660 | 3662 | 3664 | 3666 | 3668 | 3670 | 3672 |
| H1H18166B | 3674 | 3676 | 3678 | 3680 | 3682 | 3684 | 3686 | 3688 |
| H1H18167B | 3690 | 3692 | 3694 | 3696 | 3698 | 3700 | 3702 | 3704 |
| H1H18168B | 3706 | 3708 | 3710 | 3712 | 3714 | 3716 | 3718 | 3720 |
| H1H18169B | 3722 | 3724 | 3726 | 3728 | 3730 | 3732 | 3734 | 3736 |
| H1H18170B | 3738 | 3740 | 3742 | 3744 | 3746 | 3748 | 3750 | 3752 |
| H1H18171B | 3754 | 3756 | 3758 | 3760 | 3762 | 3764 | 3766 | 3768 |
| H1H18172B | 3770 | 3772 | 3774 | 3776 | 3778 | 3780 | 3782 | 3784 |
| H1H18173B | 3786 | 3788 | 3790 | 3792 | 3794 | 3796 | 3798 | 3800 |
| H1H18174B | 3802 | 3804 | 3806 | 3808 | 3810 | 3812 | 3814 | 3816 |
| H1H18175B | 3818 | 3820 | 3822 | 3824 | 3826 | 3828 | 3830 | 3832 |
| H1H18176B | 3834 | 3836 | 3838 | 3840 | 3842 | 3844 | 3846 | 3848 |
| H1H18177B | 3850 | 3852 | 3854 | 3856 | 3858 | 3860 | 3862 | 3864 |
| H1H18178B | 3866 | 3868 | 3870 | 3872 | 3874 | 3876 | 3878 | 3880 |
| H1H18179B | 3882 | 3884 | 3886 | 3888 | 3890 | 3892 | 3894 | 3896 |
| H1H18180B | 3898 | 3900 | 3902 | 3904 | 3906 | 3908 | 3910 | 3912 |
| H1H18181B | 3914 | 3916 | 3918 | 3920 | 3922 | 3924 | 3926 | 3928 |
| H1H18182B | 3930 | 3932 | 3934 | 3936 | 3938 | 3940 | 3942 | 3944 |
| H1H18183B | 3946 | 3948 | 3950 | 3952 | 3954 | 3956 | 3958 | 3960 |
| H1H18184B | 3962 | 3964 | 3966 | 3968 | 3970 | 3972 | 3974 | 3976 |
| H1H18185B | 3978 | 3980 | 3982 | 3984 | 3986 | 3988 | 3990 | 3992 |
| H1H18186B | 3994 | 3996 | 3998 | 4000 | 4002 | 4004 | 4006 | 4008 |
| H1H18187B | 4010 | 4012 | 4014 | 4016 | 4018 | 4020 | 4022 | 4024 |
| H1H18188B | 4026 | 4028 | 4030 | 4032 | 4034 | 4036 | 4038 | 4040 |
| H1H18189B | 4042 | 4044 | 4046 | 4048 | 4050 | 4052 | 4054 | 4056 |
| H1H18190B | 4058 | 4060 | 4062 | 4064 | 4066 | 4068 | 4070 | 4072 |
| H1H18191B | 4074 | 4076 | 4078 | 4080 | 4082 | 4084 | 4086 | 4088 |
| H1H18192B | 4090 | 4092 | 4094 | 4096 | 4098 | 4100 | 4102 | 4104 |
| H1H18193B | 4106 | 4108 | 4110 | 4112 | 4114 | 4116 | 4118 | 4120 |
| H1H18194B | 4122 | 4124 | 4126 | 4128 | 4130 | 4132 | 4134 | 4136 |
| H1H18195B | 4138 | 4140 | 4142 | 4144 | 4146 | 4148 | 4150 | 4152 |
| H1H18196B | 4154 | 4156 | 4158 | 4160 | 4162 | 4164 | 4166 | 4168 |
| H1H18197B | 4170 | 4172 | 4174 | 4176 | 4178 | 4180 | 4182 | 4184 |
| H1H18198B | 4186 | 4188 | 4190 | 4192 | 4194 | 4196 | 4198 | 4200 |
| H1H18199B | 4202 | 4204 | 4206 | 4208 | 4210 | 4212 | 4214 | 4216 |
| H1H18200B | 4218 | 4220 | 4222 | 4224 | 4226 | 4228 | 4230 | 4232 |
| H1H18201B | 4234 | 4236 | 4238 | 4240 | 4242 | 4244 | 4246 | 4248 |
| H1H18202B | 4250 | 4252 | 4254 | 4256 | 4258 | 4260 | 4262 | 4264 |
| H1H18203B | 4266 | 4268 | 4270 | 4272 | 4274 | 4276 | 4278 | 4280 |
| H1H18204B | 4282 | 4284 | 4286 | 4288 | 4290 | 4292 | 4294 | 4296 |
| H1H18205B | 4298 | 4300 | 4302 | 4304 | 4306 | 4308 | 4310 | 4312 |
| H1H18206B | 4314 | 4316 | 4318 | 4320 | 4322 | 4324 | 4326 | 4328 |
| H1H18207B | 4330 | 4332 | 4334 | 4336 | 4338 | 4340 | 4342 | 4344 |
| H1H18208B | 4346 | 4348 | 4350 | 4352 | 4354 | 4356 | 4358 | 4360 |
| H1H18209B | 4362 | 4364 | 4366 | 4368 | 4370 | 4372 | 4374 | 4376 |
| H1H18210B | 4378 | 4380 | 4382 | 4384 | 4386 | 4388 | 4390 | 4392 |
| H1H18211B | 4394 | 4396 | 4398 | 4400 | 4402 | 4404 | 4406 | 4408 |
| H1H18212B | 4410 | 4412 | 4414 | 4416 | 4418 | 4420 | 4422 | 4424 |
| H1H18213B | 4426 | 4428 | 4430 | 4432 | 4434 | 4436 | 4438 | 4440 |
| H1H18214B | 4442 | 4444 | 4446 | 4448 | 4450 | 4452 | 4454 | 4456 |
| H1H18216B | 4458 | 4460 | 4462 | 4464 | 4466 | 4468 | 4470 | 4472 |
| H1H18217B | 4474 | 4476 | 4478 | 4480 | 4482 | 4484 | 4486 | 4488 |
| H1H18218B | 4490 | 4492 | 4494 | 4496 | 4498 | 4500 | 4502 | 4504 |
| H1H18219B | 4506 | 4508 | 4510 | 4512 | 4514 | 4516 | 4518 | 4520 |
| H1H18220B | 4522 | 4524 | 4526 | 4528 | 4530 | 4532 | 4534 | 4536 |
| H1H18221B | 4538 | 4540 | 4542 | 4544 | 4546 | 4548 | 4550 | 4552 |
| H1H18222B | 4554 | 4556 | 4558 | 4560 | 4562 | 4564 | 4566 | 4568 |
| H1H18223B | 4570 | 4572 | 4574 | 4576 | 4578 | 4580 | 4582 | 4584 |
| H1H18224B | 4586 | 4588 | 4590 | 4592 | 4594 | 4596 | 4598 | 4600 |
| H1H18225B | 4602 | 4604 | 4606 | 4608 | 4610 | 4612 | 4614 | 4616 |
| H1H18226B | 4618 | 4620 | 4622 | 4624 | 4626 | 4628 | 4630 | 4632 |
| H1H18227B | 4634 | 4636 | 4638 | 4640 | 4642 | 4644 | 4646 | 4648 |
| H1H18228B | 4650 | 4652 | 4654 | 4656 | 4658 | 4660 | 4662 | 4664 |
| H1H18229B | 4666 | 4668 | 4670 | 4672 | 4674 | 4676 | 4678 | 4680 |
| H1H18230B | 4682 | 4684 | 4686 | 4688 | 4690 | 4692 | 4694 | 4696 |
| H1H18231B | 4698 | 4700 | 4702 | 4704 | 4706 | 4708 | 4710 | 4712 |
| H1H18232B | 4714 | 4716 | 4718 | 4720 | 4722 | 4724 | 4726 | 4728 |
| H1H18233B | 4730 | 4732 | 4734 | 4736 | 4738 | 4740 | 4742 | 4744 |
| H1H18234B | 4746 | 4748 | 4750 | 4752 | 4754 | 4756 | 4758 | 4760 |
| H1H18235B | 4762 | 4764 | 4766 | 4768 | 4770 | 4772 | 4774 | 4776 |
| H1H18236B | 4778 | 4780 | 4782 | 4784 | 4786 | 4788 | 4790 | 4792 |
| H1H18237B | 4794 | 4796 | 4798 | 4800 | 4802 | 4804 | 4806 | 4808 |
| H1H18238B | 4810 | 4812 | 4814 | 4816 | 4818 | 4820 | 4822 | 4824 |
| H1H18239B | 4826 | 4828 | 4830 | 4832 | 4834 | 4836 | 4838 | 4840 |

TABLE 12-continued

Amino Acid Sequence Identifiers
Amino Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H18240B | 4842 | 4844 | 4846 | 4848 | 4850 | 4852 | 4854 | 4856 |
| H1H18241B | 4858 | 4860 | 4862 | 4864 | 4866 | 4868 | 4870 | 4872 |
| H1H18242B | 4874 | 4876 | 4878 | 4880 | 4882 | 4884 | 4886 | 4888 |
| H1H18243B | 4890 | 4892 | 4894 | 4896 | 4898 | 4900 | 4902 | 4904 |
| H1H18244B | 4906 | 4908 | 4910 | 4912 | 4914 | 4916 | 4918 | 4920 |
| H1H18245B | 4922 | 4924 | 4926 | 4928 | 4930 | 4932 | 4934 | 4936 |
| H1H18246B | 4938 | 4940 | 4942 | 4944 | 4946 | 4948 | 4950 | 4952 |
| H1H18247B | 4954 | 4956 | 4958 | 4960 | 4962 | 4964 | 4966 | 4968 |
| H1H18248B | 4970 | 4972 | 4974 | 4976 | 4978 | 4980 | 4982 | 4984 |
| H1H18249B | 4986 | 4988 | 4990 | 4992 | 4994 | 4996 | 4998 | 5000 |
| H1H18250B | 5002 | 5004 | 5006 | 5008 | 5010 | 5012 | 5014 | 5016 |
| H1H18251B | 5018 | 5020 | 5022 | 5024 | 5026 | 5028 | 5030 | 5032 |
| H1H18252B | 5034 | 5036 | 5038 | 5040 | 5042 | 5044 | 5046 | 5048 |
| H1H18253B | 5050 | 5052 | 5054 | 5056 | 5058 | 5060 | 5062 | 5064 |
| H1H18254B | 5066 | 5068 | 5070 | 5072 | 5074 | 5076 | 5078 | 5080 |
| H1H18255B | 5082 | 5084 | 5086 | 5088 | 5090 | 5092 | 5094 | 5096 |
| H1H18256B | 5098 | 5100 | 5102 | 5104 | 5106 | 5108 | 5110 | 5112 |
| H1H18257B | 5114 | 5116 | 5118 | 5120 | 5122 | 5124 | 5126 | 5128 |
| H1H18258B | 5130 | 5132 | 5134 | 5136 | 5138 | 5140 | 5142 | 5144 |
| H1H18259B | 5146 | 5148 | 5150 | 5152 | 5154 | 5156 | 5158 | 5160 |
| H1H18261B | 5162 | 5164 | 5166 | 5168 | 5170 | 5172 | 5174 | 5176 |
| H1H18262B | 5178 | 5180 | 5182 | 5184 | 5186 | 5188 | 5190 | 5192 |
| H1H18263B | 5194 | 5196 | 5198 | 5200 | 5202 | 5204 | 5206 | 5208 |
| H1H18264B | 5210 | 5212 | 5214 | 5216 | 5218 | 5220 | 5222 | 5224 |
| H1H18265B | 5226 | 5228 | 5230 | 5232 | 5234 | 5236 | 5238 | 5240 |
| H1H18266B | 5242 | 5244 | 5246 | 5248 | 5250 | 5252 | 5254 | 5256 |
| H1H18267B | 5258 | 5260 | 5262 | 5264 | 5266 | 5268 | 5270 | 5272 |
| H1H18268B | 5274 | 5276 | 5278 | 5280 | 5282 | 5284 | 5286 | 5288 |
| H1H18269B | 5290 | 5292 | 5294 | 5296 | 5298 | 5300 | 5302 | 5304 |
| H1H18270B | 5306 | 5308 | 5310 | 5312 | 5314 | 5316 | 5318 | 5320 |
| H1H18271B | 5322 | 5324 | 5326 | 5328 | 5330 | 5332 | 5334 | 5336 |
| H1H18272B | 5338 | 5340 | 5342 | 5344 | 5346 | 5348 | 5350 | 5352 |
| H1H18274B | 5354 | 5356 | 5358 | 5360 | 5362 | 5364 | 5366 | 5368 |
| H1H18275B | 5370 | 5372 | 5374 | 5376 | 5378 | 5380 | 5382 | 5384 |
| H1H18276B | 5386 | 5388 | 5390 | 5392 | 5394 | 5396 | 5398 | 5400 |
| H1H18277B | 5402 | 5404 | 5406 | 5408 | 5410 | 5412 | 5414 | 5416 |
| H1H18278B | 5418 | 5420 | 5422 | 5424 | 5426 | 5428 | 5430 | 5432 |
| H1H18279B | 5434 | 5436 | 5438 | 5440 | 5442 | 5444 | 5446 | 5448 |
| H1H18280B | 5450 | 5452 | 5454 | 5456 | 5458 | 5460 | 5462 | 5464 |
| H1H18281B | 5466 | 5468 | 5470 | 5472 | 5474 | 5476 | 5478 | 5480 |
| H1H18282B | 5482 | 5484 | 5486 | 5488 | 5490 | 5492 | 5494 | 5496 |
| H1H18283B | 5498 | 5500 | 5502 | 5504 | 5506 | 5508 | 5510 | 5512 |
| H1H18284B | 5514 | 5516 | 5518 | 5520 | 5522 | 5524 | 5526 | 5528 |
| H1H18285B | 5530 | 5532 | 5534 | 5536 | 5538 | 5540 | 5542 | 5544 |
| H1H18286B | 5546 | 5548 | 5550 | 5552 | 5554 | 5556 | 5558 | 5560 |
| H1H18287B | 5562 | 5564 | 5566 | 5568 | 5570 | 5572 | 5574 | 5576 |
| H1H18288B | 5578 | 5580 | 5582 | 5584 | 5586 | 5588 | 5590 | 5592 |
| H1H18289B | 5594 | 5596 | 5598 | 5600 | 5602 | 5604 | 5606 | 5608 |
| H1H18290B | 5610 | 5612 | 5614 | 5616 | 5618 | 5620 | 5622 | 5624 |
| H1H18291B | 5626 | 5628 | 5630 | 5632 | 5634 | 5636 | 5638 | 5640 |
| H1H18292B | 5642 | 5644 | 5646 | 5648 | 5650 | 5652 | 5654 | 5656 |
| H1H18293B | 5658 | 5660 | 5662 | 5664 | 5666 | 5668 | 5670 | 5672 |
| H1H18294B | 5674 | 5676 | 5678 | 5680 | 5682 | 5684 | 5686 | 5688 |
| H1H18295B | 5690 | 5692 | 5694 | 5696 | 5698 | 5700 | 5702 | 5704 |
| H1H18297B | 5706 | 5708 | 5710 | 5712 | 5714 | 5716 | 5718 | 5720 |
| H1H18298B | 5722 | 5724 | 5726 | 5728 | 5730 | 5732 | 5734 | 5736 |
| H1H18299B | 5738 | 5740 | 5742 | 5744 | 5746 | 5748 | 5750 | 5752 |
| H1H18300B | 5754 | 5756 | 5758 | 5760 | 5762 | 5764 | 5766 | 5768 |
| H1H18301B | 5770 | 5772 | 5774 | 5776 | 5778 | 5780 | 5782 | 5784 |
| H1H18302B | 5786 | 5788 | 5790 | 5792 | 5794 | 5796 | 5798 | 5800 |
| H1H18303B | 5802 | 5804 | 5806 | 5808 | 5810 | 5812 | 5814 | 5816 |
| H1H18304B | 5818 | 5820 | 5822 | 5824 | 5826 | 5828 | 5830 | 5832 |
| H1H18305B | 5834 | 5836 | 5838 | 5840 | 5842 | 5844 | 5846 | 5848 |
| H1H18306B | 5850 | 5852 | 5854 | 5856 | 5858 | 5860 | 5862 | 5864 |
| H1H18307B | 5866 | 5868 | 5870 | 5872 | 5874 | 5876 | 5878 | 5880 |
| H1H18308B | 5882 | 5884 | 5886 | 5888 | 5890 | 5892 | 5894 | 5896 |
| H1H18309B | 5898 | 5900 | 5902 | 5904 | 5906 | 5908 | 5910 | 5912 |
| H1H18310B | 5914 | 5916 | 5918 | 5920 | 5922 | 5924 | 5926 | 5928 |
| H1H18311B | 5930 | 5932 | 5934 | 5936 | 5938 | 5940 | 5942 | 5944 |
| H1H18312B | 5946 | 5948 | 5950 | 5952 | 5954 | 5956 | 5958 | 5960 |
| H1H18313B | 5962 | 5964 | 5966 | 5968 | 5970 | 5972 | 5974 | 5976 |
| H1H18314B | 5978 | 5980 | 5982 | 5984 | 5986 | 5988 | 5990 | 5992 |
| H1H18315B | 5994 | 5996 | 5998 | 6000 | 6002 | 6004 | 6006 | 6008 |
| H1H18316B | 6010 | 6012 | 6014 | 6016 | 6018 | 6020 | 6022 | 6024 |

TABLE 12-continued

Amino Acid Sequence Identifiers
Amino Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H18317B | 6026 | 6028 | 6030 | 6032 | 6034 | 6036 | 6038 | 6040 |
| H1H18318B | 6042 | 6044 | 6046 | 6048 | 6050 | 6052 | 6054 | 6056 |
| H1H18319B | 6058 | 6060 | 6062 | 6064 | 6066 | 6068 | 6070 | 6072 |
| H1H18320B | 6074 | 6076 | 6078 | 6080 | 6082 | 6084 | 6086 | 6088 |
| H1H18321B | 6090 | 6092 | 6094 | 6096 | 6098 | 6100 | 6102 | 6104 |
| H1H18322B | 6106 | 6108 | 6110 | 6112 | 6114 | 6116 | 6118 | 6120 |
| H1H18323B | 6122 | 6124 | 6126 | 6128 | 6130 | 6132 | 6134 | 6136 |
| H1H18324B | 6138 | 6140 | 6142 | 6144 | 6146 | 6148 | 6150 | 6152 |
| H1H18325B | 6154 | 6156 | 6158 | 6160 | 6162 | 6164 | 6166 | 6168 |
| H1H18326B | 6170 | 6172 | 6174 | 6176 | 6178 | 6180 | 6182 | 6184 |
| H1H18327B | 6186 | 6188 | 6190 | 6192 | 6194 | 6196 | 6198 | 6200 |
| H1H18328B | 6202 | 6204 | 6206 | 6208 | 6210 | 6212 | 6214 | 6216 |
| H1H18329B | 6218 | 6220 | 6222 | 6224 | 6226 | 6228 | 6230 | 6232 |
| H1H18330B | 6234 | 6236 | 6238 | 6240 | 6242 | 6244 | 6246 | 6248 |
| H1H18331B | 6250 | 6252 | 6254 | 6256 | 6258 | 6260 | 6262 | 6264 |
| H1H18332B | 6266 | 6268 | 6270 | 6272 | 6274 | 6276 | 6278 | 6280 |
| H1H18333B | 6282 | 6284 | 6286 | 6288 | 6290 | 6292 | 6294 | 6296 |
| H1H18334B | 6298 | 6300 | 6302 | 6304 | 6306 | 6308 | 6310 | 6312 |
| H1H18335B | 6314 | 6316 | 6318 | 6320 | 6322 | 6324 | 6326 | 6328 |

TABLE 13

Nucleic Acid Sequence Identifiers
Nucleic Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H17952B | 297 | 299 | 301 | 303 | 305 | 307 | 309 | 311 |
| H1H17953B | 313 | 315 | 317 | 319 | 321 | 323 | 325 | 327 |
| H1H17954B | 329 | 331 | 333 | 335 | 337 | 339 | 341 | 343 |
| H1H17955B | 345 | 347 | 349 | 351 | 353 | 355 | 357 | 359 |
| H1H17956B | 361 | 363 | 365 | 367 | 369 | 371 | 373 | 375 |
| H1H17957B | 377 | 379 | 381 | 383 | 385 | 387 | 389 | 391 |
| H1H17958B | 393 | 395 | 397 | 399 | 401 | 403 | 405 | 407 |
| H1H17959B | 409 | 411 | 413 | 415 | 417 | 419 | 421 | 423 |
| H1H17960B | 425 | 427 | 429 | 431 | 433 | 435 | 437 | 439 |
| H1H17961B | 441 | 443 | 445 | 447 | 449 | 451 | 453 | 455 |
| H1H17962B | 457 | 459 | 461 | 463 | 465 | 467 | 469 | 471 |
| H1H17963B | 473 | 475 | 477 | 479 | 481 | 483 | 485 | 487 |
| H1H17964B | 489 | 491 | 493 | 495 | 497 | 499 | 501 | 503 |
| H1H17965B | 505 | 507 | 509 | 511 | 513 | 515 | 517 | 519 |
| H1H17966B | 521 | 523 | 525 | 527 | 529 | 531 | 533 | 535 |
| H1H17967B | 537 | 539 | 541 | 543 | 545 | 547 | 549 | 551 |
| H1H17968B | 553 | 555 | 557 | 559 | 561 | 563 | 565 | 567 |
| H1H17969B | 569 | 571 | 573 | 575 | 577 | 579 | 581 | 583 |
| H1H17970B | 585 | 587 | 589 | 591 | 593 | 595 | 597 | 599 |
| H1H17971B | 601 | 603 | 605 | 607 | 609 | 611 | 613 | 615 |
| H1H17972B | 617 | 619 | 621 | 623 | 625 | 627 | 629 | 631 |
| H1H17973B | 633 | 635 | 637 | 639 | 641 | 643 | 645 | 647 |
| H1H17974B | 649 | 651 | 653 | 655 | 657 | 659 | 661 | 663 |
| H1H17975B | 665 | 667 | 669 | 671 | 673 | 675 | 677 | 679 |
| H1H17976B | 681 | 683 | 685 | 687 | 689 | 691 | 693 | 695 |
| H1H17977B | 697 | 699 | 701 | 703 | 705 | 707 | 709 | 711 |
| H1H17978B | 713 | 715 | 717 | 719 | 721 | 723 | 725 | 727 |
| H1H17979B | 729 | 731 | 733 | 735 | 737 | 739 | 741 | 743 |
| H1H17980B | 745 | 747 | 749 | 751 | 753 | 755 | 757 | 759 |
| H1H17981B | 761 | 763 | 765 | 767 | 769 | 771 | 773 | 775 |
| H1H17982B | 111 | 779 | 781 | 783 | 785 | 787 | 789 | 791 |
| H1H17983B | 793 | 795 | 797 | 799 | 801 | 803 | 805 | 807 |
| H1H17984B | 809 | 811 | 813 | 815 | 817 | 819 | 821 | 823 |
| H1H17985B | 825 | 827 | 829 | 831 | 833 | 835 | 837 | 839 |
| H1H17986B | 841 | 843 | 845 | 847 | 849 | 851 | 853 | 855 |
| H1H17987B | 857 | 859 | 861 | 863 | 865 | 867 | 869 | 871 |
| H1H17988B | 873 | 875 | 877 | 879 | 881 | 883 | 885 | 887 |
| H1H17989B | 889 | 891 | 893 | 895 | 897 | 899 | 901 | 903 |
| H1H17990B | 905 | 907 | 909 | 911 | 913 | 915 | 917 | 919 |
| H1H17991B | 921 | 923 | 925 | 927 | 929 | 931 | 933 | 935 |
| H1H17992B | 937 | 939 | 941 | 943 | 945 | 947 | 949 | 951 |
| H1H17993B | 953 | 955 | 957 | 959 | 961 | 963 | 965 | 967 |
| H1H17994B | 969 | 971 | 973 | 975 | 977 | 979 | 981 | 983 |

TABLE 13-continued

Nucleic Acid Sequence Identifiers
Nucleic Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H17995B | 985 | 987 | 989 | 991 | 993 | 995 | 997 | 999 |
| H1H17996B | 1001 | 1003 | 1005 | 1007 | 1009 | 1011 | 1013 | 1015 |
| H1H17997B | 1017 | 1019 | 1021 | 1023 | 1025 | 1027 | 1029 | 1031 |
| H1H17998B | 1033 | 1035 | 1037 | 1039 | 1041 | 1043 | 1045 | 1047 |
| H1H17999B | 1049 | 1051 | 1053 | 1055 | 1057 | 1059 | 1061 | 1063 |
| H1H18000B | 1065 | 1067 | 1069 | 1071 | 1073 | 1075 | 1077 | 1079 |
| H1H18001B | 1081 | 1083 | 1085 | 1087 | 1089 | 1091 | 1093 | 1095 |
| H1H18002B | 1097 | 1099 | 1101 | 1103 | 1105 | 1107 | 1109 | 1111 |
| H1H18003B | 1113 | 1115 | 1117 | 1119 | 1121 | 1123 | 1125 | 1127 |
| H1H18004B | 1129 | 1131 | 1133 | 1135 | 1137 | 1139 | 1141 | 1143 |
| H1H18005B | 1145 | 1147 | 1149 | 1151 | 1153 | 1155 | 1157 | 1159 |
| H1H18006B | 1161 | 1163 | 1165 | 1167 | 1169 | 1171 | 1173 | 1175 |
| H1H18007B | 1177 | 1179 | 1181 | 1183 | 1185 | 1187 | 1189 | 1191 |
| H1H18008B | 1193 | 1195 | 1197 | 1199 | 1201 | 1203 | 1205 | 1207 |
| H1H18009B | 1209 | 1211 | 1213 | 1215 | 1217 | 1219 | 1221 | 1223 |
| H1H18010B | 1225 | 1227 | 1229 | 1231 | 1233 | 1235 | 1237 | 1239 |
| H1H18011B | 1241 | 1243 | 1245 | 1247 | 1249 | 1251 | 1253 | 1255 |
| H1H18012B | 1257 | 1259 | 1261 | 1263 | 1265 | 1267 | 1269 | 1271 |
| H1H18013B | 1273 | 1275 | 1277 | 1279 | 1281 | 1283 | 1285 | 1287 |
| H1H18014B | 1289 | 1291 | 1293 | 1295 | 1297 | 1299 | 1301 | 1303 |
| H1H18015B | 1305 | 1307 | 1309 | 1311 | 1313 | 1315 | 1317 | 1319 |
| H1H18016B | 1321 | 1323 | 1325 | 1327 | 1329 | 1331 | 1333 | 1335 |
| H1H18017B | 1337 | 1339 | 1341 | 1343 | 1345 | 1347 | 1349 | 1351 |
| H1H18018B | 1353 | 1355 | 1357 | 1359 | 1361 | 1363 | 1365 | 1367 |
| H1H18019B | 1369 | 1371 | 1373 | 1375 | 1377 | 1379 | 1381 | 1383 |
| H1H18020B | 1385 | 1387 | 1389 | 1391 | 1393 | 1395 | 1397 | 1399 |
| H1H18021B | 1401 | 1403 | 1405 | 1407 | 1409 | 1411 | 1413 | 1415 |
| H1H18022B | 1417 | 1419 | 1421 | 1423 | 1425 | 1427 | 1429 | 1431 |
| H1H18023B | 1433 | 1435 | 1437 | 1439 | 1441 | 1443 | 1445 | 1447 |
| H1H18024B | 1449 | 1451 | 1453 | 1455 | 1457 | 1459 | 1461 | 1463 |
| H1H18025B | 1465 | 1467 | 1469 | 1471 | 1473 | 1475 | 1477 | 1479 |
| H1H18026B | 1481 | 1483 | 1485 | 1487 | 1489 | 1491 | 1493 | 1495 |
| H1H18027B | 1497 | 1499 | 1501 | 1503 | 1505 | 1507 | 1509 | 1511 |
| H1H18028B | 1513 | 1515 | 1517 | 1519 | 1521 | 1523 | 1525 | 1527 |
| H1H18029B | 1529 | 1531 | 1533 | 1535 | 1537 | 1539 | 1541 | 1543 |
| H1H18030B | 1545 | 1547 | 1549 | 1551 | 1553 | 1555 | 1557 | 1559 |
| H1H18031B | 1561 | 1563 | 1565 | 1567 | 1569 | 1571 | 1573 | 1575 |
| H1H18032B | 1577 | 1579 | 1581 | 1583 | 1585 | 1587 | 1589 | 1591 |
| H1H18033B | 1593 | 1595 | 1597 | 1599 | 1601 | 1603 | 1605 | 1607 |
| H1H18034B | 1609 | 1611 | 1613 | 1615 | 1617 | 1619 | 1621 | 1623 |
| H1H18035B | 1625 | 1627 | 1629 | 1631 | 1633 | 1635 | 1637 | 1639 |
| H1H18037B | 1641 | 1643 | 1645 | 1647 | 1649 | 1651 | 1653 | 1655 |
| H1H18038B | 1657 | 1659 | 1661 | 1663 | 1665 | 1667 | 1669 | 1671 |
| H1H18039B | 1673 | 1675 | 1677 | 1679 | 1681 | 1683 | 1685 | 1687 |
| H1H18040B | 1689 | 1691 | 1693 | 1695 | 1697 | 1699 | 1701 | 1703 |
| H1H18041B | 1705 | 1707 | 1709 | 1711 | 1713 | 1715 | 1717 | 1719 |
| H1H18042B | 1721 | 1723 | 1725 | 1727 | 1729 | 1731 | 1733 | 1735 |
| H1H18043B | 1737 | 1739 | 1741 | 1743 | 1745 | 1747 | 1749 | 1751 |
| H1H18044B | 1753 | 1755 | 1757 | 1759 | 1761 | 1763 | 1765 | 1767 |
| H1H18045B | 1769 | 1771 | 1773 | 1775 | 1777 | 1779 | 1781 | 1783 |
| H1H18046B | 1785 | 1787 | 1789 | 1791 | 1793 | 1795 | 1797 | 1799 |
| H1H18047B | 1801 | 1803 | 1805 | 1807 | 1809 | 1811 | 1813 | 1815 |
| H1H18048B | 1817 | 1819 | 1821 | 1823 | 1825 | 1827 | 1829 | 1831 |
| H1H18049B | 1833 | 1835 | 1837 | 1839 | 1841 | 1843 | 1845 | 1847 |
| H1H18051B | 1849 | 1851 | 1853 | 1855 | 1857 | 1859 | 1861 | 1863 |
| H1H18052B | 1865 | 1867 | 1869 | 1871 | 1873 | 1875 | 1877 | 1879 |
| H1H18053B | 1881 | 1883 | 1885 | 1887 | 1889 | 1891 | 1893 | 1895 |
| H1H18054B | 1897 | 1899 | 1901 | 1903 | 1905 | 1907 | 1909 | 1911 |
| H1H18055B | 1913 | 1915 | 1917 | 1919 | 1921 | 1923 | 1925 | 1927 |
| H1H18056B | 1929 | 1931 | 1933 | 1935 | 1937 | 1939 | 1941 | 1943 |
| H1H18057B | 1945 | 1947 | 1949 | 1951 | 1953 | 1955 | 1957 | 1959 |
| H1H18058B | 1961 | 1963 | 1965 | 1967 | 1969 | 1971 | 1973 | 1975 |
| H1H18059B | 1977 | 1979 | 1981 | 1983 | 1985 | 1987 | 1989 | 1991 |
| H1H18060B | 1993 | 1995 | 1997 | 1999 | 2001 | 2003 | 2005 | 2007 |
| H1H18061B | 2009 | 2011 | 2013 | 2015 | 2017 | 2019 | 2021 | 2023 |
| H1H18062B | 2025 | 2027 | 2029 | 2031 | 2033 | 2035 | 2037 | 2039 |
| H1H18063B | 2041 | 2043 | 2045 | 2047 | 2049 | 2051 | 2053 | 2055 |
| H1H18064B | 2057 | 2059 | 2061 | 2063 | 2065 | 2067 | 2069 | 2071 |
| H1H18065B | 2073 | 2075 | 2077 | 2079 | 2081 | 2083 | 2085 | 2087 |
| H1H18066B | 2089 | 2091 | 2093 | 2095 | 2097 | 2099 | 2101 | 2103 |
| H1H18067B | 2105 | 2107 | 2109 | 2111 | 2113 | 2115 | 2117 | 2119 |
| H1H18068B | 2121 | 2123 | 2125 | 2127 | 2129 | 2131 | 2133 | 2135 |
| H1H18069B | 2137 | 2139 | 2141 | 2143 | 2145 | 2147 | 2149 | 2151 |
| H1H18070B | 2153 | 2155 | 2157 | 2159 | 2161 | 2163 | 2165 | 2167 |

TABLE 13-continued

Nucleic Acid Sequence Identifiers
Nucleic Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H18071B | 2169 | 2171 | 2173 | 2175 | 2177 | 2179 | 2181 | 2183 |
| H1H18072B | 2185 | 2187 | 2189 | 2191 | 2193 | 2195 | 2197 | 2199 |
| H1H18073B | 2201 | 2203 | 2205 | 2207 | 2209 | 2211 | 2213 | 2215 |
| H1H18074B | 2217 | 2219 | 2221 | 2223 | 2225 | 2227 | 2229 | 2231 |
| H1H18075B | 2233 | 2235 | 2237 | 2239 | 2241 | 2243 | 2245 | 2247 |
| H1H18076B | 2249 | 2251 | 2253 | 2255 | 2257 | 2259 | 2261 | 2263 |
| H1H18077B | 2265 | 2267 | 2269 | 2271 | 2273 | 2275 | 2277 | 2279 |
| H1H18078B | 2281 | 2283 | 2285 | 2287 | 2289 | 2291 | 2293 | 2295 |
| H1H18079B | 2297 | 2299 | 2301 | 2303 | 2305 | 2307 | 2309 | 2311 |
| H1H18080B | 2313 | 2315 | 2317 | 2319 | 2321 | 2323 | 2325 | 2327 |
| H1H18081B | 2329 | 2331 | 2333 | 2335 | 2337 | 2339 | 2341 | 2343 |
| H1H18082B | 2345 | 2347 | 2349 | 2351 | 2353 | 2355 | 2357 | 2359 |
| H1H18083B | 2361 | 2363 | 2365 | 2367 | 2369 | 2371 | 2373 | 2375 |
| H1H18084B | 2377 | 2379 | 2381 | 2383 | 2385 | 2387 | 2389 | 2391 |
| H1H18085B | 2393 | 2395 | 2397 | 2399 | 2401 | 2403 | 2405 | 2407 |
| H1H18086B | 2409 | 2411 | 2413 | 2415 | 2417 | 2419 | 2421 | 2423 |
| H1H18087B | 2425 | 2427 | 2429 | 2431 | 2433 | 2435 | 2437 | 2439 |
| H1H18088B | 2441 | 2443 | 2445 | 2447 | 2449 | 2451 | 2453 | 2455 |
| H1H18089B | 2457 | 2459 | 2461 | 2463 | 2465 | 2467 | 2469 | 2471 |
| H1H18090B | 2473 | 2475 | 2477 | 2479 | 2481 | 2483 | 2485 | 2487 |
| H1H18091B | 2489 | 2491 | 2493 | 2495 | 2497 | 2499 | 2501 | 2503 |
| H1H18092B | 2505 | 2507 | 2509 | 2511 | 2513 | 2515 | 2517 | 2519 |
| H1H18093B | 2521 | 2523 | 2525 | 2527 | 2529 | 2531 | 2533 | 2535 |
| H1H18094B | 2537 | 2539 | 2541 | 2543 | 2545 | 2547 | 2549 | 2551 |
| H1H18095B | 2553 | 2555 | 2557 | 2559 | 2561 | 2563 | 2565 | 2567 |
| H1H18096B | 2569 | 2571 | 2573 | 2575 | 2577 | 2579 | 2581 | 2583 |
| H1H18097B | 2585 | 2587 | 2589 | 2591 | 2593 | 2595 | 2597 | 2599 |
| H1H18098B | 2601 | 2603 | 2605 | 2607 | 2609 | 2611 | 2613 | 2615 |
| H1H18099B | 2617 | 2619 | 2621 | 2623 | 2625 | 2627 | 2629 | 2631 |
| H1H18100B | 2633 | 2635 | 2637 | 2639 | 2641 | 2643 | 2645 | 2647 |
| H1H18101B | 2649 | 2651 | 2653 | 2655 | 2657 | 2659 | 2661 | 2663 |
| H1H18102B | 2665 | 2667 | 2669 | 2671 | 2673 | 2675 | 2677 | 2679 |
| H1H18103B | 2681 | 2683 | 2685 | 2687 | 2689 | 2691 | 2693 | 2695 |
| H1H18104B | 2697 | 2699 | 2701 | 2703 | 2705 | 2707 | 2709 | 2711 |
| H1H18105B | 2713 | 2715 | 2717 | 2719 | 2721 | 2723 | 2725 | 2727 |
| H1H18107B | 2729 | 2731 | 2733 | 2735 | 2737 | 2739 | 2741 | 2743 |
| H1H18108B | 2745 | 2747 | 2749 | 2751 | 2753 | 2755 | 2757 | 2759 |
| H1H18109B | 2761 | 2763 | 2765 | 2767 | 2769 | 2771 | 2773 | 2775 |
| H1H18110B | 2777 | 2779 | 2781 | 2783 | 2785 | 2787 | 2789 | 2791 |
| H1H18111B | 2793 | 2795 | 2797 | 2799 | 2801 | 2803 | 2805 | 2807 |
| H1H18112B | 2809 | 2811 | 2813 | 2815 | 2817 | 2819 | 2821 | 2823 |
| H1H18113B | 2825 | 2827 | 2829 | 2831 | 2833 | 2835 | 2837 | 2839 |
| H1H18114B | 2841 | 2843 | 2845 | 2847 | 2849 | 2851 | 2853 | 2855 |
| H1H18115B | 2857 | 2859 | 2861 | 2863 | 2865 | 2867 | 2869 | 2871 |
| H1H18116B | 2873 | 2875 | 2877 | 2879 | 2881 | 2883 | 2885 | 2887 |
| H1H18117B | 2889 | 2891 | 2893 | 2895 | 2897 | 2899 | 2901 | 2903 |
| H1H18118B | 2905 | 2907 | 2909 | 2911 | 2913 | 2915 | 2917 | 2919 |
| H1H18119B | 2921 | 2923 | 2925 | 2927 | 2929 | 2931 | 2933 | 2935 |
| H1H18120B | 2937 | 2939 | 2941 | 2943 | 2945 | 2947 | 2949 | 2951 |
| H1H18121B | 2953 | 2955 | 2957 | 2959 | 2961 | 2963 | 2965 | 2967 |
| H1H18122B | 2969 | 2971 | 2973 | 2975 | 2977 | 2979 | 2981 | 2983 |
| H1H18123B | 2985 | 2987 | 2989 | 2991 | 2993 | 2995 | 2997 | 2999 |
| H1H18124B | 3001 | 3003 | 3005 | 3007 | 3009 | 3011 | 3013 | 3015 |
| H1H18125B | 3017 | 3019 | 3021 | 3023 | 3025 | 3027 | 3029 | 3031 |
| H1H18126B | 3033 | 3035 | 3037 | 3039 | 3041 | 3043 | 3045 | 3047 |
| H1H18127B | 3049 | 3051 | 3053 | 3055 | 3057 | 3059 | 3061 | 3063 |
| H1H18128B | 3065 | 3067 | 3069 | 3071 | 3073 | 3075 | 3077 | 3079 |
| H1H18129B | 3081 | 3083 | 3085 | 3087 | 3089 | 3091 | 3093 | 3095 |
| H1H18130B | 3097 | 3099 | 3101 | 3103 | 3105 | 3107 | 3109 | 3111 |
| H1H18131B | 3113 | 3115 | 3117 | 3119 | 3121 | 3123 | 3125 | 3127 |
| H1H18132B | 3129 | 3131 | 3133 | 3135 | 3137 | 3139 | 3141 | 3143 |
| H1H18133B | 3145 | 3147 | 3149 | 3151 | 3153 | 3155 | 3157 | 3159 |
| H1H18134B | 3161 | 3163 | 3165 | 3167 | 3169 | 3171 | 3173 | 3175 |
| H1H18135B | 3177 | 3179 | 3181 | 3183 | 3185 | 3187 | 3189 | 3191 |
| H1H18136B | 3193 | 3195 | 3197 | 3199 | 3201 | 3203 | 3205 | 3207 |
| H1H18137B | 3209 | 3211 | 3213 | 3215 | 3217 | 3219 | 3221 | 3223 |
| H1H18138B | 3225 | 3227 | 3229 | 3231 | 3233 | 3235 | 3237 | 3239 |
| H1H18139B | 3241 | 3243 | 3245 | 3247 | 3249 | 3251 | 3253 | 3255 |
| H1H18140B | 3257 | 3259 | 3261 | 3263 | 3265 | 3267 | 3269 | 3271 |
| H1H18141B | 3273 | 3275 | 3277 | 3279 | 3281 | 3283 | 3285 | 3287 |
| H1H18142B | 3289 | 3291 | 3293 | 3295 | 3297 | 3299 | 3301 | 3303 |
| H1H18143B | 3305 | 3307 | 3309 | 3311 | 3313 | 3315 | 3317 | 3319 |
| H1H18144B | 3321 | 3323 | 3325 | 3327 | 3329 | 3331 | 3333 | 3335 |
| H1H18145B | 3337 | 3339 | 3341 | 3343 | 3345 | 3347 | 3349 | 3351 |

TABLE 13-continued

Nucleic Acid Sequence Identifiers
Nucleic Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H18146B | 3353 | 3355 | 3357 | 3359 | 3361 | 3363 | 3365 | 3367 |
| H1H18147B | 3369 | 3371 | 3373 | 3375 | 3377 | 3379 | 3381 | 3383 |
| H1H18148B | 3385 | 3387 | 3389 | 3391 | 3393 | 3395 | 3397 | 3399 |
| H1H18149B | 3401 | 3403 | 3405 | 3407 | 3409 | 3411 | 3413 | 3415 |
| H1H18150B | 3417 | 3419 | 3421 | 3423 | 3425 | 3427 | 3429 | 3431 |
| H1H18151B | 3433 | 3435 | 3437 | 3439 | 3441 | 3443 | 3445 | 3447 |
| H1H18152B | 3449 | 3451 | 3453 | 3455 | 3457 | 3459 | 3461 | 3463 |
| H1H18153B | 3465 | 3467 | 3469 | 3471 | 3473 | 3475 | 3477 | 3479 |
| H1H18154B | 3481 | 3483 | 3485 | 3487 | 3489 | 3491 | 3493 | 3495 |
| H1H18155B | 3497 | 3499 | 3501 | 3503 | 3505 | 3507 | 3509 | 3511 |
| H1H18156B | 3513 | 3515 | 3517 | 3519 | 3521 | 3523 | 3525 | 3527 |
| H1H18157B | 3529 | 3531 | 3533 | 3535 | 3537 | 3539 | 3541 | 3543 |
| H1H18158B | 3545 | 3547 | 3549 | 3551 | 3553 | 3555 | 3557 | 3559 |
| H1H18159B | 3561 | 3563 | 3565 | 3567 | 3569 | 3571 | 3573 | 3575 |
| H1H18160B | 3577 | 3579 | 3581 | 3583 | 3585 | 3587 | 3589 | 3591 |
| H1H18161B | 3593 | 3595 | 3597 | 3599 | 3601 | 3603 | 3605 | 3607 |
| H1H18162B | 3609 | 3611 | 3613 | 3615 | 3617 | 3619 | 3621 | 3623 |
| H1H18163B | 3625 | 3627 | 3629 | 3631 | 3633 | 3635 | 3637 | 3639 |
| H1H18164B | 3641 | 3643 | 3645 | 3647 | 3649 | 3651 | 3653 | 3655 |
| H1H18165B | 3657 | 3659 | 3661 | 3663 | 3665 | 3667 | 3669 | 3671 |
| H1H18166B | 3673 | 3675 | 3677 | 3679 | 3681 | 3683 | 3685 | 3687 |
| H1H18167B | 3689 | 3691 | 3693 | 3695 | 3697 | 3699 | 3701 | 3703 |
| H1H18168B | 3705 | 3707 | 3709 | 3711 | 3713 | 3715 | 3717 | 3719 |
| H1H18169B | 3721 | 3723 | 3725 | 3727 | 3729 | 3731 | 3733 | 3735 |
| H1H18170B | 3737 | 3739 | 3741 | 3743 | 3745 | 3747 | 3749 | 3751 |
| H1H18171B | 3753 | 3755 | 3757 | 3759 | 3761 | 3763 | 3765 | 3767 |
| H1H18172B | 3769 | 3771 | 3773 | 3775 | 3777 | 3779 | 3781 | 3783 |
| H1H18173B | 3785 | 3787 | 3789 | 3791 | 3793 | 3795 | 3797 | 3799 |
| H1H18174B | 3801 | 3803 | 3805 | 3807 | 3809 | 3811 | 3813 | 3815 |
| H1H18175B | 3817 | 3819 | 3821 | 3823 | 3825 | 3827 | 3829 | 3831 |
| H1H18176B | 3833 | 3835 | 3837 | 3839 | 3841 | 3843 | 3845 | 3847 |
| H1H18177B | 3849 | 3851 | 3853 | 3855 | 3857 | 3859 | 3861 | 3863 |
| H1H18178B | 3865 | 3867 | 3869 | 3871 | 3873 | 3875 | 3877 | 3879 |
| H1H18179B | 3881 | 3883 | 3885 | 3887 | 3889 | 3891 | 3893 | 3895 |
| H1H18180B | 3897 | 3899 | 3901 | 3903 | 3905 | 3907 | 3909 | 3911 |
| H1H18181B | 3913 | 3915 | 3917 | 3919 | 3921 | 3923 | 3925 | 3927 |
| H1H18182B | 3929 | 3931 | 3933 | 3935 | 3937 | 3939 | 3941 | 3943 |
| H1H18183B | 3945 | 3947 | 3949 | 3951 | 3953 | 3955 | 3957 | 3959 |
| H1H18184B | 3961 | 3963 | 3965 | 3967 | 3969 | 3971 | 3973 | 3975 |
| H1H18185B | 3977 | 3979 | 3981 | 3983 | 3985 | 3987 | 3989 | 3991 |
| H1H18186B | 3993 | 3995 | 3997 | 3999 | 4001 | 4003 | 4005 | 4007 |
| H1H18187B | 4009 | 4011 | 4013 | 4015 | 4017 | 4019 | 4021 | 4023 |
| H1H18188B | 4025 | 4027 | 4029 | 4031 | 4033 | 4035 | 4037 | 4039 |
| H1H18189B | 4041 | 4043 | 4045 | 4047 | 4049 | 4051 | 4053 | 4055 |
| H1H18190B | 4057 | 4059 | 4061 | 4063 | 4065 | 4067 | 4069 | 4071 |
| H1H18191B | 4073 | 4075 | 4077 | 4079 | 4081 | 4083 | 4085 | 4087 |
| H1H18192B | 4089 | 4091 | 4093 | 4095 | 4097 | 4099 | 4101 | 4103 |
| H1H18193B | 4105 | 4107 | 4109 | 4111 | 4113 | 4115 | 4117 | 4119 |
| H1H18194B | 4121 | 4123 | 4125 | 4127 | 4129 | 4131 | 4133 | 4135 |
| H1H18195B | 4137 | 4139 | 4141 | 4143 | 4145 | 4147 | 4149 | 4151 |
| H1H18196B | 4153 | 4155 | 4157 | 4159 | 4161 | 4163 | 4165 | 4167 |
| H1H18197B | 4169 | 4171 | 4173 | 4175 | 4177 | 4179 | 4181 | 4183 |
| H1H18198B | 4185 | 4187 | 4189 | 4191 | 4193 | 4195 | 4197 | 4199 |
| H1H18199B | 4201 | 4203 | 4205 | 4207 | 4209 | 4211 | 4213 | 4215 |
| H1H18200B | 4217 | 4219 | 4221 | 4223 | 4225 | 4227 | 4229 | 4231 |
| H1H18201B | 4233 | 4235 | 4237 | 4239 | 4241 | 4243 | 4245 | 4247 |
| H1H18202B | 4249 | 4251 | 4253 | 4255 | 4257 | 4259 | 4261 | 4263 |
| H1H18203B | 4265 | 4267 | 4269 | 4271 | 4273 | 4275 | 4277 | 4279 |
| H1H18204B | 4281 | 4283 | 4285 | 4287 | 4289 | 4291 | 4293 | 4295 |
| H1H18205B | 4297 | 4299 | 4301 | 4303 | 4305 | 4307 | 4309 | 4311 |
| H1H18206B | 4313 | 4315 | 4317 | 4319 | 4321 | 4323 | 4325 | 4327 |
| H1H18207B | 4329 | 4331 | 4333 | 4335 | 4337 | 4339 | 4341 | 4343 |
| H1H18208B | 4345 | 4347 | 4349 | 4351 | 4353 | 4355 | 4357 | 4359 |
| H1H18209B | 4361 | 4363 | 4365 | 4367 | 4369 | 4371 | 4373 | 4375 |
| H1H18210B | 4377 | 4379 | 4381 | 4383 | 4385 | 4387 | 4389 | 4391 |
| H1H18211B | 4393 | 4395 | 4397 | 4399 | 4401 | 4403 | 4405 | 4407 |
| H1H18212B | 4409 | 4411 | 4413 | 4415 | 4417 | 4419 | 4421 | 4423 |
| H1H18213B | 4425 | 4427 | 4429 | 4431 | 4433 | 4435 | 4437 | 4439 |
| H1H18214B | 4441 | 4443 | 4445 | 4447 | 4449 | 4451 | 4453 | 4455 |
| H1H18216B | 4457 | 4459 | 4461 | 4463 | 4465 | 4467 | 4469 | 4471 |
| H1H18217B | 4473 | 4475 | 4477 | 4479 | 4481 | 4483 | 4485 | 4487 |
| H1H18218B | 4489 | 4491 | 4493 | 4495 | 4497 | 4499 | 4501 | 4503 |
| H1H18219B | 4505 | 4507 | 4509 | 4511 | 4513 | 4515 | 4517 | 4519 |
| H1H18220B | 4521 | 4523 | 4525 | 4527 | 4529 | 4531 | 4533 | 4535 |

TABLE 13-continued

Nucleic Acid Sequence Identifiers
Nucleic Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H18221B | 4537 | 4539 | 4541 | 4543 | 4545 | 4547 | 4549 | 4551 |
| H1H18222B | 4553 | 4555 | 4557 | 4559 | 4561 | 4563 | 4565 | 4567 |
| H1H18223B | 4569 | 4571 | 4573 | 4575 | 4577 | 4579 | 4581 | 4583 |
| H1H18224B | 4585 | 4587 | 4589 | 4591 | 4593 | 4595 | 4597 | 4599 |
| H1H18225B | 4601 | 4603 | 4605 | 4607 | 4609 | 4611 | 4613 | 4615 |
| H1H18226B | 4617 | 4619 | 4621 | 4623 | 4625 | 4627 | 4629 | 4631 |
| H1H18227B | 4633 | 4635 | 4637 | 4639 | 4641 | 4643 | 4645 | 4647 |
| H1H18228B | 4649 | 4651 | 4653 | 4655 | 4657 | 4659 | 4661 | 4663 |
| H1H18229B | 4665 | 4667 | 4669 | 4671 | 4673 | 4675 | 4677 | 4679 |
| H1H18230B | 4681 | 4683 | 4685 | 4687 | 4689 | 4691 | 4693 | 4695 |
| H1H18231B | 4697 | 4699 | 4701 | 4703 | 4705 | 4707 | 4709 | 4711 |
| H1H18232B | 4713 | 4715 | 4717 | 4719 | 4721 | 4723 | 4725 | 4727 |
| H1H18233B | 4729 | 4731 | 4733 | 4735 | 4737 | 4739 | 4741 | 4743 |
| H1H18234B | 4745 | 4747 | 4749 | 4751 | 4753 | 4755 | 4757 | 4759 |
| H1H18235B | 4761 | 4763 | 4765 | 4767 | 4769 | 4771 | 4773 | 4775 |
| H1H18236B | 4777 | 4779 | 4781 | 4783 | 4785 | 4787 | 4789 | 4791 |
| H1H18237B | 4793 | 4795 | 4797 | 4799 | 4801 | 4803 | 4805 | 4807 |
| H1H18238B | 4809 | 4811 | 4813 | 4815 | 4817 | 4819 | 4821 | 4823 |
| H1H18239B | 4825 | 4827 | 4829 | 4831 | 4833 | 4835 | 4837 | 4839 |
| H1H18240B | 4841 | 4843 | 4845 | 4847 | 4849 | 4851 | 4853 | 4855 |
| H1H18241B | 4857 | 4859 | 4861 | 4863 | 4865 | 4867 | 4869 | 4871 |
| H1H18242B | 4873 | 4875 | 4877 | 4879 | 4881 | 4883 | 4885 | 4887 |
| H1H18243B | 4889 | 4891 | 4893 | 4895 | 4897 | 4899 | 4901 | 4903 |
| H1H18244B | 4905 | 4907 | 4909 | 4911 | 4913 | 4915 | 4917 | 4919 |
| H1H18245B | 4921 | 4923 | 4925 | 4927 | 4929 | 4931 | 4933 | 4935 |
| H1H18246B | 4937 | 4939 | 4941 | 4943 | 4945 | 4947 | 4949 | 4951 |
| H1H18247B | 4953 | 4955 | 4957 | 4959 | 4961 | 4963 | 4965 | 4967 |
| H1H18248B | 4969 | 4971 | 4973 | 4975 | 4977 | 4979 | 4981 | 4983 |
| H1H18249B | 4985 | 4987 | 4989 | 4991 | 4993 | 4995 | 4997 | 4999 |
| H1H18250B | 5001 | 5003 | 5005 | 5007 | 5009 | 5011 | 5013 | 5015 |
| H1H18251B | 5017 | 5019 | 5021 | 5023 | 5025 | 5027 | 5029 | 5031 |
| H1H18252B | 5033 | 5035 | 5037 | 5039 | 5041 | 5043 | 5045 | 5047 |
| H1H18253B | 5049 | 5051 | 5053 | 5055 | 5057 | 5059 | 5061 | 5063 |
| H1H18254B | 5065 | 5067 | 5069 | 5071 | 5073 | 5075 | 5077 | 5079 |
| H1H18255B | 5081 | 5083 | 5085 | 5087 | 5089 | 5091 | 5093 | 5095 |
| H1H18256B | 5097 | 5099 | 5101 | 5103 | 5105 | 5107 | 5109 | 5111 |
| H1H18257B | 5113 | 5115 | 5117 | 5119 | 5121 | 5123 | 5125 | 5127 |
| H1H18258B | 5129 | 5131 | 5133 | 5135 | 5137 | 5139 | 5141 | 5143 |
| H1H18259B | 5145 | 5147 | 5149 | 5151 | 5153 | 5155 | 5157 | 5159 |
| H1H18261B | 5161 | 5163 | 5165 | 5167 | 5169 | 5171 | 5173 | 5175 |
| H1H18262B | 5177 | 5179 | 5181 | 5183 | 5185 | 5187 | 5189 | 5191 |
| H1H18263B | 5193 | 5195 | 5197 | 5199 | 5201 | 5203 | 5205 | 5207 |
| H1H18264B | 5209 | 5211 | 5213 | 5215 | 5217 | 5219 | 5221 | 5223 |
| H1H18265B | 5225 | 5227 | 5229 | 5231 | 5233 | 5235 | 5237 | 5239 |
| H1H18266B | 5241 | 5243 | 5245 | 5247 | 5249 | 5251 | 5253 | 5255 |
| H1H18267B | 5257 | 5259 | 5261 | 5263 | 5265 | 5267 | 5269 | 5271 |
| H1H18268B | 5273 | 5275 | 5277 | 5279 | 5281 | 5283 | 5285 | 5287 |
| H1H18269B | 5289 | 5291 | 5293 | 5295 | 5297 | 5299 | 5301 | 5303 |
| H1H18270B | 5305 | 5307 | 5309 | 5311 | 5313 | 5315 | 5317 | 5319 |
| H1H18271B | 5321 | 5323 | 5325 | 5327 | 5329 | 5331 | 5333 | 5335 |
| H1H18272B | 5337 | 5339 | 5341 | 5343 | 5345 | 5347 | 5349 | 5351 |
| H1H18274B | 5353 | 5355 | 5357 | 5359 | 5361 | 5363 | 5365 | 5367 |
| H1H18275B | 5369 | 5371 | 5373 | 5375 | 5377 | 5379 | 5381 | 5383 |
| H1H18276B | 5385 | 5387 | 5389 | 5391 | 5393 | 5395 | 5397 | 5399 |
| H1H18277B | 5401 | 5403 | 5405 | 5407 | 5409 | 5411 | 5413 | 5415 |
| H1H18278B | 5417 | 5419 | 5421 | 5423 | 5425 | 5427 | 5429 | 5431 |
| H1H18279B | 5433 | 5435 | 5437 | 5439 | 5441 | 5443 | 5445 | 5447 |
| H1H18280B | 5449 | 5451 | 5453 | 5455 | 5457 | 5459 | 5461 | 5463 |
| H1H18281B | 5465 | 5467 | 5469 | 5471 | 5473 | 5475 | 5477 | 5479 |
| H1H18282B | 5481 | 5483 | 5485 | 5487 | 5489 | 5491 | 5493 | 5495 |
| H1H18283B | 5497 | 5499 | 5501 | 5503 | 5505 | 5507 | 5509 | 5511 |
| H1H18284B | 5513 | 5515 | 5517 | 5519 | 5521 | 5523 | 5525 | 5527 |
| H1H18285B | 5529 | 5531 | 5533 | 5535 | 5537 | 5539 | 5541 | 5543 |
| H1H18286B | 5545 | 5547 | 5549 | 5551 | 5553 | 5555 | 5557 | 5559 |
| H1H18287B | 5561 | 5563 | 5565 | 5567 | 5569 | 5571 | 5573 | 5575 |
| H1H18288B | 5577 | 5579 | 5581 | 5583 | 5585 | 5587 | 5589 | 5591 |
| H1H18289B | 5593 | 5595 | 5597 | 5599 | 5601 | 5603 | 5605 | 5607 |
| H1H18290B | 5609 | 5611 | 5613 | 5615 | 5617 | 5619 | 5621 | 5623 |
| H1H18291B | 5625 | 5627 | 5629 | 5631 | 5633 | 5635 | 5637 | 5639 |
| H1H18292B | 5641 | 5643 | 5645 | 5647 | 5649 | 5651 | 5653 | 5655 |
| H1H18293B | 5657 | 5659 | 5661 | 5663 | 5665 | 5667 | 5669 | 5671 |
| H1H18294B | 5673 | 5675 | 5677 | 5679 | 5681 | 5683 | 5685 | 5687 |
| H1H18295B | 5689 | 5691 | 5693 | 5695 | 5697 | 5699 | 5701 | 5703 |
| H1H18297B | 5705 | 5707 | 5709 | 5711 | 5713 | 5715 | 5717 | 5719 |

TABLE 13-continued

Nucleic Acid Sequence Identifiers
Nucleic Acid SEQ ID NOs:

| Antibody Designation | HCVR | HCDR1 | HCDR2 | HCDR3 | LCVR | LCDR1 | LCDR2 | LCDR3 |
|---|---|---|---|---|---|---|---|---|
| H1H18298B | 5721 | 5723 | 5725 | 5727 | 5729 | 5731 | 5733 | 5735 |
| H1H18299B | 5737 | 5739 | 5741 | 5743 | 5745 | 5747 | 5749 | 5751 |
| H1H18300B | 5753 | 5755 | 5757 | 5759 | 5761 | 5763 | 5765 | 5767 |
| H1H18301B | 5769 | 5771 | 5773 | 5775 | 5777 | 5779 | 5781 | 5783 |
| H1H18302B | 5785 | 5787 | 5789 | 5791 | 5793 | 5795 | 5797 | 5799 |
| H1H18303B | 5801 | 5803 | 5805 | 5807 | 5809 | 5811 | 5813 | 5815 |
| H1H18304B | 5817 | 5819 | 5821 | 5823 | 5825 | 5827 | 5829 | 5831 |
| H1H18305B | 5833 | 5835 | 5837 | 5839 | 5841 | 5843 | 5845 | 5847 |
| H1H18306B | 5849 | 5851 | 5853 | 5855 | 5857 | 5859 | 5861 | 5863 |
| H1H18307B | 5865 | 5867 | 5869 | 5871 | 5873 | 5875 | 5877 | 5879 |
| H1H18308B | 5881 | 5883 | 5885 | 5887 | 5889 | 5891 | 5893 | 5895 |
| H1H18309B | 5897 | 5899 | 5901 | 5903 | 5905 | 5907 | 5909 | 5911 |
| H1H18310B | 5913 | 5915 | 5917 | 5919 | 5921 | 5923 | 5925 | 5927 |
| H1H18311B | 5929 | 5931 | 5933 | 5935 | 5937 | 5939 | 5941 | 5943 |
| H1H18312B | 5945 | 5947 | 5949 | 5951 | 5953 | 5955 | 5957 | 5959 |
| H1H18313B | 5961 | 5963 | 5965 | 5967 | 5969 | 5971 | 5973 | 5975 |
| H1H18314B | 5977 | 5979 | 5981 | 5983 | 5985 | 5987 | 5989 | 5991 |
| H1H18315B | 5993 | 5995 | 5997 | 5999 | 6001 | 6003 | 6005 | 6007 |
| H1H18316B | 6009 | 6011 | 6013 | 6015 | 6017 | 6019 | 6021 | 6023 |
| H1H18317B | 6025 | 6027 | 6029 | 6031 | 6033 | 6035 | 6037 | 6039 |
| H1H18318B | 6041 | 6043 | 6045 | 6047 | 6049 | 6051 | 6053 | 6055 |
| H1H18319B | 6057 | 6059 | 6061 | 6063 | 6065 | 6067 | 6069 | 6071 |
| H1H18320B | 6073 | 6075 | 6077 | 6079 | 6081 | 6083 | 6085 | 6087 |
| H1H18321B | 6089 | 6091 | 6093 | 6095 | 6097 | 6099 | 6101 | 6103 |
| H1H18322B | 6105 | 6107 | 6109 | 6111 | 6113 | 6115 | 6117 | 6119 |
| H1H18323B | 6121 | 6123 | 6125 | 6127 | 6129 | 6131 | 6133 | 6135 |
| H1H18324B | 6137 | 6139 | 6141 | 6143 | 6145 | 6147 | 6149 | 6151 |
| H1H18325B | 6153 | 6155 | 6157 | 6159 | 6161 | 6163 | 6165 | 6167 |
| H1H18326B | 6169 | 6171 | 6173 | 6175 | 6177 | 6179 | 6181 | 6183 |
| H1H18327B | 6185 | 6187 | 6189 | 6191 | 6193 | 6195 | 6197 | 6199 |
| H1H18328B | 6201 | 6203 | 6205 | 6207 | 6209 | 6211 | 6213 | 6215 |
| H1H18329B | 6217 | 6219 | 6221 | 6223 | 6225 | 6227 | 6229 | 6231 |
| H1H18330B | 6233 | 6235 | 6237 | 6239 | 6241 | 6243 | 6245 | 6247 |
| H1H18331B | 6249 | 6251 | 6253 | 6255 | 6257 | 6259 | 6261 | 6263 |
| H1H18332B | 6265 | 6267 | 6269 | 6271 | 6273 | 6275 | 6277 | 6279 |
| H1H18333B | 6281 | 6283 | 6285 | 6287 | 6289 | 6291 | 6293 | 6295 |
| H1H18334B | 6297 | 6299 | 6301 | 6303 | 6305 | 6307 | 6309 | 6311 |
| H1H18335B | 6313 | 6315 | 6317 | 6319 | 6321 | 6323 | 6325 | 6327 |

Example 9. H1H11729P has a Superior Pharmacokinetic Profile in Mice and Non-Human Primates (NHPs) Compared to a Comparator Antibody (Control I mAb)

A study was conducted to compare the pharmacokinetic profile of H1H11729P with a comparator antibody in mice and in non-human primates. One anti-influenza HA comparator antibody designated herein as Control I mAb, is an anti-influenza HA antibody with heavy (HC) and light chain (LC) amino acid sequences as set forth in WO2008/028946 as SEQ ID NO: 65 (HC) and SEQ ID NO: 91 (LC) and is also referred to in WO2008/028946 as CR6261.

For both the mouse and NHP PK experiments, circulating drug levels were determined by total human antibody analysis using an ELISA immunoassay. Briefly, a goat anti-human IgG polyclonal antibody was coated onto 96-well plates to capture the tested human antibodies in the sera, and then plate bound antibodies were detected using a goat anti-human IgG polyclonal antibody conjugated with horseradish and TMB substrate. The serum samples were in six-dose serial dilutions and reference standards of the respective antibodies in 12-dose serial dilutions. Drug antibody concentrations in the sera were calculated based on the reference standard curve generated using Graphpad Prism software.

A. Mouse Study

The pharmacokinetic assessment of H1H11729P was conducted in wild-type (WT) C57BL/6 mice. H1H11729P and Control I mAb were administered SC in separated groups of 5 mice each at a dose of 1 mg/kg. Bleeds were collected post-injection at 6 h, 1, 2, 3, 4, 7, 11, 14, 22, and 30 days in addition to the bleed collected one day prior to the antibody injection (pre-bleed). Serum fractions from the bleeds were separated and frozen at −80° C. until analysis was conducted.

Results:

As shown in Table 14, the half-life of H1H11729P in WT mice was 11.1 days, while the half-life of Control I mAb was 5.67 days, demonstrating an advantageous property of the H1H11729P over the comparator antibody.

TABLE 14

Summary of the Pharmacokinetic Profiles of H1H11729P and Control I mAb in Uninfected Wild-Type Mice

| Drug | $T_{1/2}$ (d) | Cmax (µ/mL) | AUC(d* µ/mL) |
|---|---|---|---|
| H1H11729P | 11.1 ± 0.8 | 12.0 ± 0.9 | 147 ± 3.4 |
| Control I mAb | 5.67 ± 0.6 | 10.4 ± 0.6 | 93.8 ± 4.8 |

B. Cynomolgus NHPs

Assessment of the pharmacokinetic clearance rate of H1H11729P and Control I mAb was conducted in 3-5 year old, female cynomolgus monkeys. Monkeys were pre-screened for influenza A and B antibodies and were found to be negative. The antibody was tested in three animals and was administered subcutaneously at a dose of 3 mg/kg (at a volume of 2 mL/kg and 1.5 mg/mL). Blood samples were collected prior to dosing and post-injection at 1 h, 4 h, 8 h, and on Days 1, 2, 3, 4, 5, 10, 14, 18, 21, 24, 28, 35, 42, 49, 56, 63, 70, 84, and 98. Serum was separated from whole blood and frozen at −80° C. until analysis. Circulating drug concentrations were determined by total human antibody analysis using an ELISA immunoassay. Drug antibody concentrations in the sera were calculated based on the reference standard curve generated using Graphpad Prism software.

Results:

As shown in Table 15, the half-life of H1H11729P in monkeys was 13.4 days, while the half-life of Control I mAb was 8.05 days, demonstrating an advantageous property of the H1H11729P over the comparator antibody.

TABLE 15

Summary of the Pharmacokinetic Profiles of H1H11729P and Control I mAb in Cynomolgus Monkeys

| Drug | $T_{1/2}$ (d) | Cmax (µg/mL) | AUC(d* µg/mL) |
|---|---|---|---|
| H1H11729P | 13.4 ± 1.46 | 41.3 ± 7.84 | 863 ± 145 |
| Control I mAb | 8.05 ± 2.17 | 24.9 ± 1.87 | 320 ± 70.1 |

Example 10: H1H11729P Effectively Treats Lethal Influenza Virus Infection in Mice There is a substantial unmet need for improved standard of care therapies for treating or preventing of influenza virus infections in humans. Currently, only two classes of drugs are available: the adamantanes and the neuraminidase inhibitors (NAIs). Adamantanes (amantadine and rimantadine) have been associated with the rapid emergence of drug-resistant strains and are no longer recommended for treatment of influenza. NAIs like oseltamivir (TAMIFLU®) are the front line drugs for treatment and prophylaxis of influenza, however, their window of efficacy is limited: NAIs have been shown to reduce the duration of fever and illness symptoms by about one day in the therapeutic setting if the antiviral is administered within 48 hours of symptom onset with little clinical evidence for efficacy if administered after 48 hours.

To evaluate the in vivo efficacy of H1H11729P in the treatment of severe influenza, experiments were conducted with the following objectives:

Study 1: To evaluate the efficacy of a single dose of H1H11729P versus the clinical standard of care oseltamivir (TAMIFLU®) given twice per day for 5 days.

Study 2: To determine the efficacy of H1H11729P administered in combination with oseltamivir.

The strain used in these studies included a historical [A/Puerto Rico/08/1934 (H1N1)] influenza A virus group 1 isolate. All experiments were performed in 6-week-old wild-type (BALB/c) female mice. Mice were challenged with 10× mouse $LD_{50}$ ($MLD_{50}$) equivalent to 800 plaque-forming units (PFUs) of A/Puerto Rico/08/1934 (H1N1). In the treatment models, mice were challenged intranasally (IN) on day 0 post-infection (p.i.) and fixed doses of mAb were given intravenously (IV) on specific days post-infection (e.g., day 1, 2, 3, 4 or 5). Oseltamivir was resuspended according to the manufacturers instructions and mice were dosed every 12 h (i.e., twice per day; BID) via oral gavage for 5 days, with the first dose administered on day 2 or 3 post-infection. Mice were weighed and observed daily up to day 14 p.i. and were sacrificed when they lost 20% of their starting weight. Results are reported as percent survival.

In the first experiment the efficacy of either a single dose of H1H11729P (15 mg/kg) or 25 or 5 mg/kg of oseltamivir BID (5 day regimen) initiating 48 hours post-infection (ie. administered therapeutically) was studied to evaluate the effect in the murine model at this timepoint. All mice receiving 5 mg/kg oseltamivir died by day 6, while the dose of 25 mg/kg improved survival to 40%; in contrast, all mice receiving H1H11729P survived (FIG. 1 and Table 16).

Figure 2:
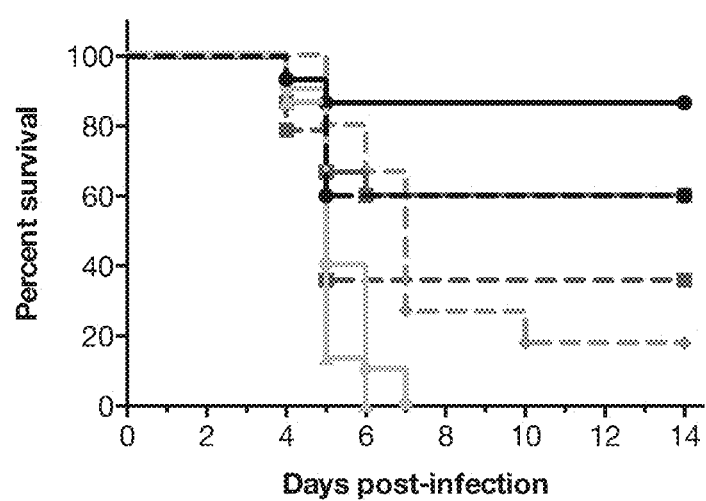
FIG. 2. Shows that additive efficacy is observed when a single dose of H1H11729P is combined with oseltamivir at 72 hrs post infection to treat severe influenza in mice. Mice received a single sub-efficacious dose of 7 (squares, dotted line) or 15 mg/kg of H1H11729P (circles, dotted line), control IgG (triangles), 25 mg/kg BID oseltamivir for 5 days (diamonds, dotted line) or a combination of a single dose of 7 (squares, solid line) or 15 mg/kg H1H11729P (circles, solid line) and the regimen of oseltamivir for 5 days 72 h after intranasal (IN) infection with 10×MLD$_{50}$ of A/Puerto Rico/08/1934 (H1N1). Results of three independent trials (N=15 per group) are shown.

In the next experiment, H1H11729P was tested in combination with oseltamivir, beginning 72 hours post-infection. While only approximately 20% of mice treated with 25 mg/kg oseltamivir survived, single doses of H1H11729P at 15 mg/kg and 7 mg/kg resulted in 60% and 36% survival, respectively. An additive effect was observed when the treatments were combined: A single dose of 7 mg/kg H1H11729P combined with a regimen of oseltamivir showed 60% survival and a single dose of 15 mg/kg H1H11729P in combination with a regimen of oseltamivir resulted in 87% survival (FIG. 2 and Table 17).

In summary, H1H11729P displayed robust efficacy in treating mice infected with a severe historical influenza strain, and in fact, demonstrated greater efficacy than oseltamivir at 48 hours post infection. Furthermore, H1H11729P demonstrated additive efficacy when administered in combination with oseltamivir.

TABLE 16

Results of Study 1: A Single Dose of H1H11729P at 48 hrs p.i. Demonstrates Greater Efficacy than oseltamivir at 48 hrs p.i. in Treating Severe Influenza A Virus Infection in Mice

| PID | Number of mice per group | Percent survival (no. of surviving mice/total no. of mice in the group) |
|---|---|---|
| Oral gavage control (uninfected) | 5 | 100 (5/5) |
| H1H11729P | 5 | 100 (5/5) |
| Oseltamivir (25 mg/kg BID x 5 d) | 5 | 40 (2/5) |
| Oseltamivir (5 mg/kg BID x 5 d) | 5 | 0 (0/5) |
| hIgG1 negative isotype control | 5 | 0 (0/5) |
| Oral gavage control (infected) | 5 | 0 (0/5) |

TABLE 17

Results of Study 2: Additive Efficacy is Observed when a Single Dose of H1H11729P is Combined with oseltamivir at 72 hrs p.i. to Treat Severe Influenza in Mice

| PID | Number of mice per group | Percent survival (no. of surviving mice/total no. of mice in the group) |
|---|---|---|
| H1H11729P (15 mg/kg) | 15 | 60 (9/15) |
| H1H11729P (7 mg/kg) | 15 | 35.7 (5/15) |
| H1H11729P (15 mg/kg) + Oseltamivir (25 mg/kg BID x 5 d) | 15 | 86.7 (13/15) |
| H1H11729P (7 mg/kg) + Oseltamivir (25 mg/kg BID x 5 d) | 15 | 60 (9/15) |
| Oseltamivir (25 mg/kg BID x 5 d) | 15 | 20 (3/15) |
| hIgG1 negative isotype control | 15 | 0 (0/15) |
| Oral gavage control (infected) | 15 | 0 (0/15) |

SEQUENCE LISTING (6328 sequences)

SEQ ID NO: 1 - DNA, 375 bp, Artificial Sequence
  synthetic
caggtgcagctggtgcagtctggggctgaggtgaagaagcctgggtcctcggtgaaggtctcctgcaaggcttctggaggcaccttcagcaactatgctatcagctgggtgcgacaggcccctggacaagggcttgagaggatgggagggatcatccctatctttggtacagcaaactacgcacagaagttccagggcagagtcacgattaccacggacgaatccacgagcacagcctacatggagctgggcagcctgagatctgaggacacggccgtgtattactgtgcgagagggaaggatttctatggttcggggagttattataacctctttgactactggggccagggaaccctggtcaccgtctcctca

SEQ ID NO: 2 - protein, 125 aa, Artificial Sequence
  synthetic
QVQLVQSGAEVKKPGSSVKVSCKASGGTFSNYAISWVRQAPGQGLERMGGIIPIFGTANYAQKFQGRVTITTDESTSTAYMELGSLRSEDTAVYYCARGKDFYGSGSYYNLFDYWGQGTLVTVSS

SEQ ID NO: 3 - DNA, 24 bp, Artificial Sequence
  synthetic
ggaggcaccttcagcaactatgct

SEQ ID NO: 4 - protein, 8 aa, Artificial Sequence
  synthetic
GGTFSNYA

SEQ ID NO: 5 - DNA, 24 bp, Artificial Sequence
  synthetic
atcatccctatctttggtacagca

SEQ ID NO: 6 - protein, 8 aa, Artificial Sequence
  synthetic
IIPIFGTA

SEQ ID NO: 7 - DNA, 54 bp, Artificial Sequence
  synthetic
gcgagagggaaggatttctatggttcggggagttattataacctctttgactac

SEQ ID NO: 8 - protein, 18 aa, Artificial Sequence
  synthetic
ARGKDFYGSGSYYNLFDY

SEQ ID NO: 9 - DNA, 321 bp, Artificial Sequence
  synthetic
gacatccagatgacccagtctccttccaccctgtctgcatctgtaggagacatagtcaccatcacttgccgggccagtcagagtattagtagctggttggcctggtatcagcagaaaccagggaaagcccctaagctcctgatctataaggcgtctagtttacaaagtggggtcccatcaaggttcagcggcagtggatctgggacagaattcactctcaccatcagcagcctgcagcctgatgattttgcaactttttactgccaacactataatacttattcgtggacgttcggccaagggaccaaggtggaaatcaaa

SEQ ID NO: 10 - protein, 107 aa, Artificial Sequence
  synthetic
DIQMTQSPSTLSASVGDIVTITCRASQSISSWLAWYQQKPGKAPKLLIYKASSLQSGVPSRFSGSGSGTEFTLTISSLQPDDFATFYCQHYNTYSWTFGQGTKVEIK

SEQ ID NO: 11 - DNA, 18 bp, Artificial Sequence
  synthetic
cagagtattagtagctgg

SEQ ID NO: 12 - protein, 6 aa, Artificial Sequence
  synthetic
QSISSW

SEQ ID NO: 13 - DNA, 9 bp, Artificial Sequence
  synthetic
aaggcgtct

SEQ ID NO: 14 - protein, 3 aa, Artificial Sequence
  synthetic
KAS

SEQ ID NO: 15 - DNA, 27 bp, Artificial Sequence
  synthetic
caacactataatacttattcgtggacg

SEQ ID NO: 16 - protein, 9 aa, Artificial Sequence
  synthetic
QHYNTYSWT

SEQ ID NO: 17 - DNA, 360 bp, Artificial Sequence
  synthetic
caggtgcagctggtgcagtctggggctgaggtgaagaagtctgggtcctcggtgaaggtctcctgcaaggcttctggaggcaccttcagcagctatgctattagctgggtgcgccaggcccctggacaagggcttgagtggatgggagggatcatccctatttttggtacaccaagctatgcacagaagttccaggacagagtcacgattaccacggacgaatccacgagcacagtttacatggagctgagcagcctgagatctgaagacacggccgtgtattactgtgcgagacagcagcccgtctaccagtacaatatggacgtctggggccaagggaccacggtcaccgtctcctca

SEQ ID NO: 18 - protein, 120 aa, Artificial Sequence
  synthetic
QVQLVQSGAEVKKSGSSVKVSCKASGGTFSSYAISWVRQAPGQGLEWMGGIIPIFGTPSYAQKFQDRVTITTDESTSTVYMELSSLRSEDTAVYYCARQQPVYQYNMDVWGQGTTVTVSS

SEQ ID NO: 19 - DNA, 24 bp, Artificial Sequence
  synthetic
ggaggcaccttcagcagctatgct

SEQ ID NO: 20 - protein, 8 aa, Artificial Sequence
  synthetic
GGTFSSYA

SEQ ID NO: 21 - DNA, 24 bp, Artificial Sequence
  synthetic
atcatccctatttttggtacacca

SEQ ID NO: 22 - protein, 8 aa, Artificial Sequence
  synthetic
IIPIFGTP

SEQ ID NO: 23 - DNA, 39 bp, Artificial Sequence
  synthetic
gcgagacagcagcccgtctaccagtacaatatggacgtc

SEQ ID NO: 24 - protein, 13 aa, Artificial Sequence
  synthetic
ARQQPVYQYNMDV

SEQ ID NO: 25 - DNA, 321 bp, Artificial Sequence
  synthetic
gacatccagatgacccagtctccatcctccctgtctgcatctgtaggagacagagtcaccatcacttgccgggcaagtcagggcattagaaataatttaggctggtatcagcagaaaccactgaaagcccctaagcgcctgatctatgctgcgtccagtttgcaaagtggggtcccatcaaggttcagcggcagtggatctgggacagaattcactctcacaatcagcagcctgcagcctgaagattttgcaacttattactgtctacaatataataattacccgtggacgttcggccaagggaccaaggtggaaatcaaa

SEQ ID NO: 26 - protein, 107 aa, Artificial Sequence
  synthetic
DIQMTQSPSSLSASVGDRVTITCRASQGIRNNLGWYQQKPLKAPKRLIYAASSLQSGVPSRFSGSGSGTEFTLTISSLQPEDFATYYCLQYNNYPWTFGQGTKVEIK

SEQ ID NO: 27 - DNA, 18 bp, Artificial Sequence
  synthetic
cagggcattagaaataat

SEQ ID NO: 28 - protein, 6 aa, Artificial Sequence
  synthetic
QGIRNN

SEQ ID NO: 29 - DNA, 9 bp, Artificial Sequence
  synthetic
gctgcgtcc

SEQ ID NO: 30 - protein, 3 aa, Artificial Sequence
  synthetic
AAS

SEQ ID NO: 31 - DNA, 27 bp, Artificial Sequence
  synthetic
ctacaatataataattacccgtggacg

SEQ ID NO: 32 - protein, 9 aa, Artificial Sequence
  synthetic
LQYNNYPWT

SEQ ID NO: 33 - DNA, 366 bp, Artificial Sequence
  synthetic
caggtgcagctggtgcagtctggggctgaagtgaagaagcctgggtcctcggtgaaggtctcctgcaaggcttctggaggcaccttcaacagctatgctatcagctgggtgcgacaggcccctggacaagggcttgagtggatgggaggcatcatccctatctttgctacaacaaacttcgcacagaagttccagggcagagtcacgattacctcggacgaatccacgaacacagcctacatggagctgaccagcctgagatctgaggacacggccgcgtattactgtgcaagggggggttggtataactggcagtacgtggggtttgactcctggggccaagggaccacggtcaccgtctcctca

SEQ ID NO: 34 - protein, 122 aa, Artificial Sequence
  synthetic
QVQLVQSGAEVKKPGSSVKVSCKASGGTFNSYAISWVRQAPGQGLEWMGGIIPIFATTNFAQKFQGRVTITSDESTNTAYMELTSLRSEDTAAYYCARGGWYNWQYVGFDSWGQGTTVTVSS

SEQ ID NO: 35 - DNA, 24 bp, Artificial Sequence
  synthetic
ggaggcaccttcaacagctatgct

SEQ ID NO: 36 - protein, 8 aa, Artificial Sequence
  synthetic
GGTFNSYA

SEQ ID NO: 37 - DNA, 24 bp, Artificial Sequence
  synthetic
atcatccctatctttgctacaaca

SEQ ID NO: 38 - protein, 8 aa, Artificial Sequence
  synthetic
IIPIFATT

SEQ ID NO: 39 - DNA, 45 bp, Artificial Sequence
  synthetic
gcaagggggggttggtataactggcagtacgtggggtttgactcc

SEQ ID NO: 40 - protein, 15 aa, Artificial Sequence
  synthetic
ARGGWYNWQYVGFDS

SEQ ID NO: 41 - DNA, 321 bp, Artificial Sequence
  synthetic
gacatccagatgacccagtctccttccaccctgtctgcatctgtaggagacagagtcgccatcacttgccgggccagtcagagtattagtacctggttggcctggtatcagcagaaaccagggaaagcccctaagctcctgatctataaggcgtctagtttagaaaatggggtcccttcaaggttcagcggcagtggatctgggacagatttcactctcaccatcagcagcctgcaggctgatgattttgcaacttattactgccaaaagtataatagtaattcgtggacgttcggccaagggaccaaggtggatatcaaa

SEQ ID NO: 42 - protein, 107 aa, Artificial Sequence
  synthetic
DIQMTQSPSTLSASVGDRVAITCRASQSISTWLAWYQQKPGKAPKLLIYKASSLENGVPSRFSGSGSGTDFTLTISSLQADDFATYYCQKYNSNSWTFGQGTKVDIK

SEQ ID NO: 43 - DNA, 18 bp, Artificial Sequence
  synthetic
cagagtattagtacctgg

SEQ ID NO: 44 - protein, 6 aa, Artificial Sequence
  synthetic
QSISTW

SEQ ID NO: 45 - DNA, 9 bp, Artificial Sequence
  synthetic
aaggcgtct

SEQ ID NO: 46 - protein, 3 aa, Artificial Sequence
  synthetic
KAS

SEQ ID NO: 47 - DNA, 27 bp, Artificial Sequence
  synthetic
caaaagtataatagtaattcgtggacg

SEQ ID NO: 48 - protein, 9 aa, Artificial Sequence
  synthetic
QKYNSNSWT

SEQ ID NO: 49 - DNA, 360 bp, Artificial Sequence
  synthetic
caggtccacctggtgcagtctgggccagaggtgaagaagcctgggtcctcggtgaaggtctcctgcaaggcttctggagtcaccttcatcagtcatgctatcagctgggtgcgacaggcccctggacaagggcttgaatgggtgggaggaatcatcgctatctttggtacaacaaactacgcacagaagttccagggcagagtcacggttacaacggacaaatccacgaacacagtctacatggaattgagcagactgagatctgaggacacggccatttattactgtgcgcgaggtgagacctactacgagggaaactttgacttctggggccagggaaccctggtcaccgtctcctca

SEQ ID NO: 50 - protein, 120 aa, Artificial Sequence
  synthetic
QVHLVQSGPEVKKPGSSVKVSCKASGVTFISHAISWVRQAPGQGLEWVGGIIAIFGTTNYAQKFQGRVTVTTDKSTNTVYMELSRLRSEDTAIYYCARGETYYEGNFDFWGQGTLVTVSS

SEQ ID NO: 51 - DNA, 24 bp, Artificial Sequence
  synthetic
ggagtcaccttcatcagtcatgct

SEQ ID NO: 52 - protein, 8 aa, Artificial Sequence
  synthetic
GVTFISHA

SEQ ID NO: 53 - DNA, 24 bp, Artificial Sequence
  synthetic
atcatcgctatctttggtacaaca

SEQ ID NO: 54 - protein, 8 aa, Artificial Sequence
  synthetic
IIAIFGTT

SEQ ID NO: 55 - DNA, 39 bp, Artificial Sequence
  synthetic
gcgcgaggtgagacctactacgagggaaactttgacttc

SEQ ID NO: 56 - protein, 13 aa, Artificial Sequence
  synthetic
ARGETYYEGNFDF

SEQ ID NO: 57 - DNA, 324 bp, Artificial Sequence
  synthetic
gtcatccagatgacccagtctccatcctccctgtctgcatctgtaggagacagagtcaccatcacttgccgggccagtcagagcgttaggagtaatttaaattggtatcagcagacaccagggaaagcccctaggctcctgatctatgctgcatccagtttgcaaagtggggtcccatcaaggttcagtggcagtggatctgggacagatttcactctcaccatcagcagtctgcaacctgaagattttgcaacttattactgtcaacagagttacagtacccctccgatcaccttcggccaagggacacgactggagattaaa

SEQ ID NO: 58 - protein, 108 aa, Artificial Sequence
  synthetic
VIQMTQSPSSLSASVGDRVTITCRASQSVRSNLNWYQQTPGKAPRLLIYAASSLQSGVPSRFSGSGSGTDFTLTISSLQPEDFATYYCQQSYSTPPITFGQGTRLEIK

SEQ ID NO: 59 - DNA, 18 bp, Artificial Sequence
  synthetic
cagagcgttaggagtaat

SEQ ID NO: 60 - protein, 6 aa, Artificial Sequence
  synthetic
QSVRSN

SEQ ID NO: 61 - DNA, 9 bp, Artificial Sequence
  synthetic
gctgcatcc

SEQ ID NO: 62 - protein, 3 aa, Artificial Sequence
  synthetic
AAS

SEQ ID NO: 63 - DNA, 30 bp, Artificial Sequence
  synthetic
caacagagttacagtacccctccgatcacc

SEQ ID NO: 64 - protein, 10 aa, Artificial Sequence
  synthetic
QQSYSTPPIT

SEQ ID NO: 65 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccgtcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 66 - protein, 108 aa, Artificial Sequence
  synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 67 - DNA, 18 bp, Artificial Sequence
  synthetic
cagagcattagcagctat

SEQ ID NO: 68 - protein, 6 aa, Artificial Sequence
  synthetic
QSISSY

SEQ ID NO: 69 - DNA, 9 bp, Artificial Sequence
  synthetic
gctgcatcc

SEQ ID NO: 70 - protein, 3 aa, Artificial Sequence
  synthetic
AAS

SEQ ID NO: 71 - DNA, 30 bp, Artificial Sequence; identical to SEQ ID NO: 63
  synthetic

SEQ ID NO: 72 - protein, 10 aa, Artificial Sequence
  synthetic
QQSYSTPPIT

SEQ ID NO: 73 - DNA, 369 bp, Artificial Sequence
  synthetic
caggtgcagctggtgcagtctggagcagaggtgaggaagcctgggtcctcggtgaaggtctcctgcaaggcttctggaggaaccttcaccggccatgctatcagctgggtgcgacaggcccctggacaaggccttgagtggatgggaggggtcgtccctatctttggttcagcaaactacgcacagaagttccagggcagagtcacgatgaccatggacgaatccacgagtacagcctacatggacctgagcagcctgagatctgaggacacggccgtttattattgtgtgagagatccgggcaactcgggatactactactacggtatggacgtctggggccaagggaccacggtcaccgtctcctca

SEQ ID NO: 74 - protein, 123 aa, Artificial Sequence
  synthetic
QVQLVQSGAEVRKPGSSVKVSCKASGGTFTGHAISWVRQAPGQGLEWMGGVVPIFGSANYAQKFQGRVTMTMDESTSTAYMDLSSLRSEDTAVYYCVRDPGNSGYYYYGMDVWGQGTTVTVSS

SEQ ID NO: 75 - DNA, 24 bp, Artificial Sequence
  synthetic
ggaggaaccttcaccggccatgct

SEQ ID NO: 76 - protein, 8 aa, Artificial Sequence
  synthetic
GGTFTGHA

SEQ ID NO: 77 - DNA, 24 bp, Artificial Sequence
  synthetic
gtcgtccctatctttggttcagca

SEQ ID NO: 78 - protein, 8 aa, Artificial Sequence
  synthetic
VVPIFGSA

SEQ ID NO: 79 - DNA, 48 bp, Artificial Sequence
  synthetic
gtgagagatccgggcaactcgggatactactactacggtatggacgtc

SEQ ID NO: 80 - protein, 16 aa, Artificial Sequence
  synthetic
VRDPGNSGYYYYGMDV

SEQ ID NO: 81 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtttcagcagaaaccagggaaagcccctaagctcctgatctatactgcatccagtttgcaaagtggggtcccatcaaggttcagtggcagtggatctgggacagatttcactctcaccatcagcagtctgcaacctgaagattttgcaacttactactgtcaacagagttacagttcccctccgatcaccttcggccaagggacacgactggagattaaa

SEQ ID NO: 82 - protein, 108 aa, Artificial Sequence
  synthetic
DIQMTQSPSSLSASVGDRVTITCRASQSISSYLNWFQQKPGKAPKLLIYTASSLQSGVPSRFSGSGSGTDFTLTISSLQPEDFATYYCQQSYSSPPITFGQGTRLEIK

SEQ ID NO: 83 - DNA, 18 bp, Artificial Sequence
  synthetic
cagagcattagcagctat

SEQ ID NO: 84 - protein, 6 aa, Artificial Sequence
  synthetic
QSISSY

SEQ ID NO: 85 - DNA, 9 bp, Artificial Sequence
  synthetic
actgcatcc

SEQ ID NO: 86 - protein, 3 aa, Artificial Sequence
  synthetic
TAS

SEQ ID NO: 87 - DNA, 30 bp, Artificial Sequence
  synthetic
caacagagttacagttcccctccgatcacc

SEQ ID NO: 88 - protein, 10 aa, Artificial Sequence
  synthetic
QQSYSSPPIT

SEQ ID NO: 89 - DNA, 369 bp, Artificial Sequence
  synthetic
caggtccacctggtgcagtctggggctgaggtgaagaagcctgggtcgtcggtgaaggtctcctgcaaggcttctggaggcaccttcagcacctatgctatcacctgggtgcgacaggcccctggacaagggcttgagtggataggagggatcagccgtttctttggttcagcaaactacgcacagaagtttcagggcagagtcacaattaccacggacgaatccacgaacacagcctacatggaactaagcagcctgagatctgaggacacggccgtatattattgtgcgagagatcctggaaacacgggctattatttttacggtatggacgtctggggccaagggaccacggtcaccgtctcctca

SEQ ID NO: 90 - protein, 123 aa, Artificial Sequence
  synthetic
QVHLVQSGAEVKKPGSSVKVSCKASGGTFSTYAITWVRQAPGQGLEWIGGISRFFGSANYAQKFQGRVTITTDESTNTAYMELSSLRSEDTAVYYCARDPGNTGYYFYGMDVWGQGTTVTVSS

SEQ ID NO: 91 - DNA, 24 bp, Artificial Sequence
  synthetic
ggaggcaccttcagcacctatgct

SEQ ID NO: 92 - protein, 8 aa, Artificial Sequence
  synthetic
GGTFSTYA

SEQ ID NO: 93 - DNA, 24 bp, Artificial Sequence
  synthetic
atcagccgtttctttggttcagca

SEQ ID NO: 94 - protein, 8 aa, Artificial Sequence
  synthetic
ISRFFGSA

SEQ ID NO: 95 - DNA, 48 bp, Artificial Sequence
  synthetic
gcgagagatcctggaaacacgggctattatttttacggtatggacgtc

SEQ ID NO: 96 - protein, 16 aa, Artificial Sequence
  synthetic
ARDPGNTGYYFYGMDV

SEQ ID NO: 97 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatggtgcatccagtttgcaaagtggggtcccatcaaggttcagtggcagtggatctgggacagatttcactctcaccatcagcagtctgcaacctgaagattttgcaacttactactgtcaacagagtaagagtaattctccgatcaccttcggccaagggacacgactggagattaaa

SEQ ID NO: 98 - protein, 108 aa, Artificial Sequence
  synthetic
DIQMTQSPSSLSASVGDRVTITCRASQSISSYLNWYQQKPGKAPKLLIYGASSLQSGVPSRFSGSGSGTDFTLTISSLQPEDFATYYCQQSKSNSPITFGQGTRLEIK

SEQ ID NO: 99 - DNA, 18 bp, Artificial Sequence
  synthetic
cagagcattagcagctat

SEQ ID NO: 100 - protein, 6 aa, Artificial Sequence
  synthetic
QSISSY

SEQ ID NO: 101 - DNA, 9 bp, Artificial Sequence
  synthetic
ggtgcatcc

SEQ ID NO: 102 - protein, 3 aa, Artificial Sequence
  synthetic
GAS

SEQ ID NO: 103 - DNA, 30 bp, Artificial Sequence
  synthetic
caacagagtaagagtaattctccgatcacc

SEQ ID NO: 104 - protein, 10 aa, Artificial Sequence
  synthetic
QQSKSNSPIT

SEQ ID NO: 105 - DNA, 369 bp, Artificial Sequence
  synthetic
caggtccagctggtgcagtctggggctgaggtgaagaagcctgggtcctcggtgaaggtctcctgcaaggcttctggaggcaccttcatcacctatgctatcagctgggtgcgacaggcccctggacaagggcttgagtggatgggaggtgtcatccctatctttggtactccaaggtacgcacagaagttccagggcagagtcacgattaccacggacgattccacgaccacagcctacatggagctgagcagcctgagatctgacgacacggccgtgtattattgtgcgacaaggagcagctcgtctccctattattactacggtatggacgtctggggccaagggaccacggtcaccgtctcctca

SEQ ID NO: 106 - protein, 123 aa, Artificial Sequence
  synthetic
QVQLVQSGAEVKKPGSSVKVSCKASGGTFITYAISWVRQAPGQGLEWMGGVIPIFGTPRYAQKFQGRVTITTDDSTTTAYMELSSLRSDDTAVYYCATRSSSSPYYYYGMDVWGQGTTVTVSS

SEQ ID NO: 107 - DNA, 24 bp, Artificial Sequence
  synthetic
ggaggcaccttcatcacctatgct

SEQ ID NO: 108 - protein, 8 aa, Artificial Sequence
  synthetic
GGTFITYA

SEQ ID NO: 109 - DNA, 24 bp, Artificial Sequence
  synthetic
gtcatccctatctttggtactcca

SEQ ID NO: 110 - protein, 8 aa, Artificial Sequence
  synthetic
VIPIFGTP

SEQ ID NO: 111 - DNA, 48 bp, Artificial Sequence
  synthetic
gcgacaaggagcagctcgtctccctattattactacggtatggacgtc

SEQ ID NO: 112 - protein, 16 aa, Artificial Sequence
  synthetic
ATRSSSSPYYYYGMDV

SEQ ID NO: 113 - DNA, 336 bp, Artificial Sequence
  synthetic
gatattgtgatgacccagactccactctcctcacctgtcacccttggacagccggcctccatctcctgcaggtctagtcaaagcctcgtacacagtgatggaaacacctatttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcgggatttattactgcattcaagctacacaatttccgtacacttttggccaggggaccaagctggagatcaaa

SEQ ID NO: 114 - protein, 112 aa, Artificial Sequence
  synthetic
DIVMTQTPLSSPVTLGQPASISCRSSQSLVHSDGNTYLSWLQQRPGQPPRLLIYKISNRFSGVPDRFSGSGAGTDFTLKISRVEAEDVGIYYCIQATQFPYTFGQGTKLEIK

SEQ ID NO: 115 - DNA, 33 bp, Artificial Sequence
  synthetic
caaagcctcgtacacagtgatggaaacacctat

SEQ ID NO: 116 - protein, 11 aa, Artificial Sequence
  synthetic
QSLVHSDGNTY

SEQ ID NO: 117 - DNA, 9 bp, Artificial Sequence
  synthetic
aagatttct

SEQ ID NO: 118 - protein, 3 aa, Artificial Sequence
  synthetic
KIS

SEQ ID NO: 119 - DNA, 27 bp, Artificial Sequence
  synthetic
attcaagctacacaatttccgtacact

SEQ ID NO: 120 - protein, 9 aa, Artificial Sequence
  synthetic
IQATQFPYT

SEQ ID NO: 121 - DNA, 372 bp, Artificial Sequence
  synthetic
caggtgcagctggtgcagtctggggctgaggtgaagaagcctggggcctcagtgacggtctcctgcaaggcttctggatacaccttcaccaattatgatatcaactgggtgcgacaggccactggacaaggacttgagtggttgggatggatgagccctaacagtggtaacaaaggctatgcacagaagttccagggcagagtctccatgactttgaataccgccttaagcacagcctacatggaactgagcagcctgagatctgaggacacggccgtgtattactgtgcgagatggtattgtagtgatgccagttgctatcccgatgcttttgatatctggggccaagggacaatggtcaccgtctcttca

SEQ ID NO: 122 - protein, 124 aa, Artificial Sequence
  synthetic
QVQLVQSGAEVKKPGASVTVSCKASGYTFTNYDINWVRQATGQGLEWLGWMSPNSGNKGYAQKFQGRVSMTLNTALSTAYMELSSLRSEDTAVYYCARWYCSDASCYPDAFDIWGQGTMVTVSS

SEQ ID NO: 123 - DNA, 24 bp, Artificial Sequence
  synthetic
ggatacaccttcaccaattatgat

SEQ ID NO: 124 - protein, 8 aa, Artificial Sequence
  synthetic
GYTFTNYD

SEQ ID NO: 125 - DNA, 24 bp, Artificial Sequence
  synthetic
atgagccctaacagtggtaacaaa

SEQ ID NO: 126 - protein, 8 aa, Artificial Sequence
  synthetic
MSPNSGNK

SEQ ID NO: 127 - DNA, 51 bp, Artificial Sequence
  synthetic
gcgagatggtattgtagtgatgccagttgctatcccgatgcttttgatatc

SEQ ID NO: 128 - protein, 17 aa, Artificial Sequence
  synthetic
ARWYCSDASCYPDAFDI

SEQ ID NO: 129 - DNA, 321 bp, Artificial Sequence
  synthetic
gacatccagatgacccagtctccatcttccgtgtctgcatctgtaggagacagagtcaccatcacttgtcgggcgagtcaggatttttccgactggttagcctggtatcagcagaaacctgggaaagcccctgagctcctgatctatgctacatccagtttgcatactggggtcccatcaaggttcagcggcagtggatctgggacagatttcactctcaccatcagcaccctgcagcctgaagattttgctacttactattgtctacaggctaacaatttcccgctcactttcggcggagggaccaaggtggagatcaaa

SEQ ID NO: 130 - protein, 107 aa, Artificial Sequence
  synthetic
DIQMTQSPSSVSASVGDRVTITCRASQDFSDWLAWYQQKPGKAPELLIYATSSLHTGVPSRFSGSGSGTDFTLTISTLQPEDFATYYCLQANNFPLTFGGGTKVEIK

SEQ ID NO: 131 - DNA, 18 bp, Artificial Sequence
  synthetic
caggatttttccgactgg

SEQ ID NO: 132 - protein, 6 aa, Artificial Sequence
  synthetic
QDFSDW

SEQ ID NO: 133 - DNA, 9 bp, Artificial Sequence
  synthetic
gctacatcc

SEQ ID NO: 134 - protein, 3 aa, Artificial Sequence
  synthetic
ATS

SEQ ID NO: 135 - DNA, 27 bp, Artificial Sequence
  synthetic
ctacaggctaacaatttcccgctcact

SEQ ID NO: 136 - protein, 9 aa, Artificial Sequence
  synthetic
LQANNFPLT

SEQ ID NO: 137 - DNA, 366 bp, Artificial Sequence
  synthetic
caggtgcagctggtggagtctgggggaggcgtggcccagcctgggaggtccctgagactctcctgtgcagcctctggaatcaccttcaataactatggcatgcactgggtccgccaggctccaggcaaggggctggagtgggtggcatttatttcagatgaaggaagaaataaacactatggagactccgtgaagggccgattcaccatcgacagagacaattccaagaacacactgtatctgcaaatgaatagcctgagagctgaggacacggctgtatattactgtgcgaaattgggggataataggaatcaccactacggtttggacgtctggggccaagggaccacggtcaccgtctcctca

SEQ ID NO: 138 - protein, 122 aa, Artificial Sequence
  synthetic
QVQLVESGGGVAQPGRSLRLSCAASGITFNNYGMHWVRQAPGKGLEWVAFISDEGRNKHYGDSVKGRFTIDRDNSKNTLYLQMNSLRAEDTAVYYCAKLGDNRNHHYGLDVWGQGTTVTVSS

SEQ ID NO: 139 - DNA, 24 bp, Artificial Sequence
  synthetic
ggaatcaccttcaataactatggc

SEQ ID NO: 140 - protein, 8 aa, Artificial Sequence
  synthetic
GITFNNYG

SEQ ID NO: 141 - DNA, 24 bp, Artificial Sequence
  synthetic
atttcagatgaaggaagaaataaa

SEQ ID NO: 142 - protein, 8 aa, Artificial Sequence
  synthetic
ISDEGRNK

SEQ ID NO: 143 - DNA, 45 bp, Artificial Sequence
  synthetic
gcgaaattgggggataataggaatcaccactacggtttggacgtc

SEQ ID NO: 144 - protein, 15 aa, Artificial Sequence
  synthetic
AKLGDNRNHHYGLDV

SEQ ID NO: 145 - DNA, 321 bp, Artificial Sequence
  synthetic
gacatccagttgacccagtctccatccttcctgtctgcatctgtaggagacagagtcaccatcacttgctgggccagtcagggcattaccaattatttagcctggtatcagcaaaaaccagggaaagcccctagcctcctgatctatgctgcatccactttgcaaagtggggtcccatcaaggttcagcggcagtggacatgggacagaattcactctcacagtcagcagcctgcagcctgaagattttgtaacttattactgtcaacagtttaatagttacccgatcaccttcggccaagggacacgactggagattaaa

SEQ ID NO: 146 - protein, 107 aa, Artificial Sequence
  synthetic
DIQLTQSPSFLSASVGDRVTITCWASQGITNYLAWYQQKPGKAPSLLIYAASTLQSGVPSRFSGSGHGTEFTLTVSSLQPEDFVTYYCQQFNSYPITFGQGTRLEIK

SEQ ID NO: 147 - DNA, 18 bp, Artificial Sequence
  synthetic
cagggcattaccaattat

SEQ ID NO: 148 - protein, 6 aa, Artificial Sequence
  synthetic
QGITNY

SEQ ID NO: 149 - DNA, 9 bp, Artificial Sequence
  synthetic
gctgcatcc

SEQ ID NO: 150 - protein, 3 aa, Artificial Sequence
  synthetic
AAS

SEQ ID NO: 151 - DNA, 27 bp, Artificial Sequence
  synthetic
caacagtttaatagttacccgatcacc

SEQ ID NO: 152 - protein, 9 aa, Artificial Sequence
  synthetic
QQFNSYPIT

SEQ ID NO: 153 - DNA, 366 bp, Artificial Sequence
  synthetic
caggtccagctggtgcagtctggggctgaggtgaagaagcctgggtcctcggtgaaggtctcctgtaaggcttctggaggcaccttcagcaactatgatatcagctgggtgcgacaggcccctggacaaggacttgagtggatgggagggatcatccccatcattggtacagcaaactacgcacagaagttccagggcagagtcacgattacaacggacgaatccacgagcacagcctacatggagctgagcagcctgagatctgaggacacggccgtgtattactgtgcgagagatccgggtatagcagtggctggttcgagctttgactactggggccagggaaccctggtcaccgtctcctca

SEQ ID NO: 154 - protein, 122 aa, Artificial Sequence
  synthetic
QVQLVQSGAEVKKPGSSVKVSCKASGGTFSNYDISWVRQAPGQGLEWMGGIIPIIGTANYAQKFQGRVTITTDESTSTAYMELSSLRSEDTAVYYCARDPGIAVAGSSFDYWGQGTLVTVSS

SEQ ID NO: 155 - DNA, 24 bp, Artificial Sequence
  synthetic
ggaggcaccttcagcaactatgat

SEQ ID NO: 156 - protein, 8 aa, Artificial Sequence
  synthetic
GGTFSNYD

SEQ ID NO: 157 - DNA, 24 bp, Artificial Sequence
  synthetic
atcatccccatcattggtacagca

SEQ ID NO: 158 - protein, 8 aa, Artificial Sequence
  synthetic
IIPIIGTA

SEQ ID NO: 159 - DNA, 45 bp, Artificial Sequence
  synthetic
gcgagagatccgggtatagcagtggctggttcgagctttgactac

SEQ ID NO: 160 - protein, 15 aa, Artificial Sequence
  synthetic
ARDPGIAVAGSSFDY

SEQ ID NO: 161 - DNA, 321 bp, Artificial Sequence
  synthetic
gccatccagatgacccagtctccatcctccctgtctgcatctgttggagacagagtcaccatcacttgccgggcaagtcagggcattagacatgatttaggctggtatcagcagaaaccagggaaagcccctaagctcctgatctatgctgcatccaatttacaaagtggggtcccatcaaggttcagcggcagtggatctggcacagatttcactctcaccatcagcagcctgcagcctgaagattttgcaacttattactgtctacaagattacaattaccctcggacgttcggccaagggaccaaggtggaaatcaaa

SEQ ID NO: 162 - protein, 107 aa, Artificial Sequence
  synthetic
AIQMTQSPSSLSASVGDRVTITCRASQGIRHDLGWYQQKPGKAPKLLIYAASNLQSGVPSRFSGSGSGTDFTLTISSLQPEDFATYYCLQDYNYPRTFGQGTKVEIK

SEQ ID NO: 163 - DNA, 18 bp, Artificial Sequence
  synthetic
cagggcattagacatgat

SEQ ID NO: 164 - protein, 6 aa, Artificial Sequence
  synthetic
QGIRHD

SEQ ID NO: 165 - DNA, 9 bp, Artificial Sequence
  synthetic
gctgcatcc

SEQ ID NO: 166 - protein, 3 aa, Artificial Sequence
  synthetic
AAS

SEQ ID NO: 167 - DNA, 27 bp, Artificial Sequence
  synthetic
ctacaagattacaattaccctcggacg

SEQ ID NO: 168 - protein, 9 aa, Artificial Sequence
  synthetic
LQDYNYPRT

SEQ ID NO: 169 - DNA, 348 bp, Artificial Sequence
  synthetic
caggtgcagctggtgcagtctggggctgaggtgaggacgcctgggtcctcggtgaaggtctcctgcaaggcttctggaggcaccttcagcagctatgctgtcacctgggtgcgacaggcccctggacaagggcttgagtggatgggagggctcatccctttctttggtccagcaaactacgcacagagattccagggcagagtctcgattaccacggacgaatccacgaacatagcctacttggagctgagcagcctgagatccgaggactcggccgtttattactgtgcgagagggcggaacttcggtgactactggggccagggaaccctggtcaccgtctcctca

SEQ ID NO: 170 - protein, 116 aa, Artificial Sequence
  synthetic
QVQLVQSGAEVRTPGSSVKVSCKASGGTFSSYAVTWVRQAPGQGLEWMGGLIPFFGPANYAQRFQGRVSITTDESTNIAYLELSSLRSEDSAVYYCARGRNFGDYWGQGTLVTVSS

SEQ ID NO: 171 - DNA, 24 bp, Artificial Sequence
  synthetic
ggaggcaccttcagcagctatgct

SEQ ID NO: 172 - protein, 8 aa, Artificial Sequence
  synthetic
GGTFSSYA

SEQ ID NO: 173 - DNA, 24 bp, Artificial Sequence
  synthetic
ctcatccctttctttggtccagca

SEQ ID NO: 174 - protein, 8 aa, Artificial Sequence
  synthetic
LIPFFGPA

SEQ ID NO: 175 - DNA, 27 bp, Artificial Sequence
  synthetic
gcgagagggcggaacttcggtgactac

SEQ ID NO: 176 - protein, 9 aa, Artificial Sequence
  synthetic
ARGRNFGDY

SEQ ID NO: 177 - DNA, 321 bp, Artificial Sequence
  synthetic
gacatccagatgacccagtctccatcctcactgtctgcatctataggagacagagtcaccatcacttgtcgggcgagtcaggacattagcaattatttagcctggtttcagcagaaaccagggaaagtccctaagtccctgatctatgctgcatccaatttgcaaagtggggtcccatcaaagttcagcggcagtggatctgggacagatttcactctcaccatcagtaccctgcagcctgaagattttgcaacttattactgccaacagtatagtagttatccattcactttcggccctgggaccaaagtggatatcaaa

SEQ ID NO: 178 - protein, 107 aa, Artificial Sequence
  synthetic
DIQMTQSPSSLSASIGDRVTITCRASQDISNYLAWFQQKPGKVPKSLIYAASNLQSGVPSKFSGSGSGTDFTLTISTLQPEDFATYYCQQYSSYPFTFGPGTKVDIK

SEQ ID NO: 179 - DNA, 18 bp, Artificial Sequence
  synthetic
caggacattagcaattat

SEQ ID NO: 180 - protein, 6 aa, Artificial Sequence
  synthetic
QDISNY

SEQ ID NO: 181 - DNA, 9 bp, Artificial Sequence
  synthetic
gctgcatcc

SEQ ID NO: 182 - protein, 3 aa, Artificial Sequence
  synthetic
AAS

SEQ ID NO: 183 - DNA, 27 bp, Artificial Sequence
  synthetic
caacagtatagtagttatccattcact

SEQ ID NO: 184 - protein, 9 aa, Artificial Sequence
  synthetic
QQYSSYPFT

SEQ ID NO: 185 - DNA, 351 bp, Artificial Sequence
  synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacaacaaactacgcacagaagttccagggcagagtcacgattaccacggacgaatccacgagcacagcctacatggagctgagcagcctgagatctgaggacacggccgtgtattactgtgcgagaaggcacggtatatcctttgactactggggccagggaaccctggtcaccgtctcctca

SEQ ID NO: 186 - protein, 117 aa, Artificial Sequence
  synthetic
QVQLVQSGAEVKKPGSSVKVSCKASGGTFSSYAISWVRQAPGQGLEWMGGIIPIFGTTNYAQKFQGRVTITTDESTSTAYMELSSLRSEDTAVYYCARRHGISFDYWGQGTLVTVSS

SEQ ID NO: 187 - DNA, 24 bp, Artificial Sequence
  synthetic
ggaggcaccttcagcagctatgct

SEQ ID NO: 188 - protein, 8 aa, Artificial Sequence
  synthetic
GGTFSSYA

SEQ ID NO: 189 - DNA, 24 bp, Artificial Sequence
  synthetic
atcatccctatctttggtacaaca

SEQ ID NO: 190 - protein, 8 aa, Artificial Sequence
  synthetic
IIPIFGTT

SEQ ID NO: 191 - DNA, 30 bp, Artificial Sequence
  synthetic
gcgagaaggcacggtatatcctttgactac

SEQ ID NO: 192 - protein, 10 aa, Artificial Sequence
  synthetic
ARRHGISFDY

SEQ ID NO: 193 - DNA, 321 bp, Artificial Sequence
  synthetic
gacatccagatgacccagtctccatcctccctgtctgcatctgtaggagacagagtcaccgtcacttgccgggcaagtcagggcattagaaatgatttggcctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttatccgtggacgttcggcctagggaccaaggtggaaatcaaa

SEQ ID NO: 194 - protein, 107 aa, Artificial Sequence
  synthetic
DIQMTQSPSSLSASVGDRVTVTCRASQGIRNDLAWYQQKPGKAPKRLIYAASSLQSGVPSRFSGSGSGTEFTLTISSLQPEDFATYYCLQHNSYPWTFGLGTKVEIK

SEQ ID NO: 195 - DNA, 18 bp, Artificial Sequence
  synthetic
cagggcattagaaatgat

SEQ ID NO: 196 - protein, 6 aa, Artificial Sequence
  synthetic
QGIRND

SEQ ID NO: 197 - DNA, 9 bp, Artificial Sequence
  synthetic
gctgcatcc

SEQ ID NO: 198 - protein, 3 aa, Artificial Sequence
  synthetic
AAS

SEQ ID NO: 199 - DNA, 27 bp, Artificial Sequence
  synthetic
ctacagcataatagttatccgtggacg

SEQ ID NO: 200 - protein, 9 aa, Artificial Sequence
  synthetic
LQHNSYPWT

SEQ ID NO: 201 - DNA, 366 bp, Artificial Sequence
  synthetic
caggtgcagctggtgcagtctggggctgaggtgaagaagcctgggtcctcggtgaaggtctcctgcaaggcttctggaggcaccttcagcagctatactatcagctgggttcgacaggcccctggacaagggcttgagtggatgggagggatcagccctatctttggtacagcaaactacgcacagaagttccagggcagagtcacgattaccacggacgaatccacgagcacagcctacatggagctgagcagcctgagatctgaggacacggccgtgtattactgtgcgagagagtccccgtataactggaaccaaaaatacttccagtattggggccagggcaccctggtcaccgtctcctca

SEQ ID NO: 202 - protein, 122 aa, Artificial Sequence
  synthetic
QVQLVQSGAEVKKPGSSVKVSCKASGGTFSSYTISWVRQAPGQGLEWMGGISPIFGTANYAQKFQGRVTITTDESTSTAYMELSSLRSEDTAVYYCARESPYNWNQKYFQYWGQGTLVTVSS

SEQ ID NO: 203 - DNA, 24 bp, Artificial Sequence
  synthetic
ggaggcaccttcagcagctatact

SEQ ID NO: 204 - protein, 8 aa, Artificial Sequence
  synthetic
GGTFSSYT

SEQ ID NO: 205 - DNA, 24 bp, Artificial Sequence
  synthetic
atcagccctatctttggtacagca

SEQ ID NO: 206 - protein, 8 aa, Artificial Sequence
  synthetic
ISPIFGTA

SEQ ID NO: 207 - DNA, 45 bp, Artificial Sequence
  synthetic
gcgagagagtccccgtataactggaaccaaaaatacttccagtat

SEQ ID NO: 208 - protein, 15 aa, Artificial Sequence
  synthetic
ARESPYNWNQKYFQY

SEQ ID NO: 209 - DNA, 321 bp, Artificial Sequence
  synthetic
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgtacacttttggccaggggaccaagctggagatcaaa

SEQ ID NO: 210 - protein, 107 aa, Artificial Sequence
  synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYSYTFGQGTKLEIK

SEQ ID NO: 211 - DNA, 18 bp, Artificial Sequence
  synthetic
cagagtattagtagctgg

SEQ ID NO: 212 - protein, 6 aa, Artificial Sequence
  synthetic
QSISSW

SEQ ID NO: 213 - DNA, 9 bp, Artificial Sequence
  synthetic
aaggcgtct

SEQ ID NO: 214 - protein, 3 aa, Artificial Sequence
  synthetic
KAS

SEQ ID NO: 215 - DNA, 27 bp, Artificial Sequence
  synthetic
caacagtataatagttattcgtacact

SEQ ID NO: 216 - protein, 9 aa, Artificial Sequence
  synthetic
QQYNSYSYT

SEQ ID NO: 217 - DNA, 363 bp, Artificial Sequence
  synthetic
caggtccagctggtgcagtctgggtctgaggtgaagaagcctgggtcctcggtgaaggtctcctgcaaggcgtctggagggaccctcagcctctatgctgtcagctgggtgcgacaggcccctggacaggggcttgagtggatgggggggatcatccctatctttggtacaacaaaatacgcacaggagttccagggcagagtcacgttttccacggacgagtccacgagcacagcctacatggagctgaacagcctgcgatctgaggacacggccgtgtattactgtgcgagacaatggactatgactagaaccttggattttgacatctggggccagggaaccctggtcaccgtctcctca

SEQ ID NO: 218 - protein, 121 aa, Artificial Sequence
  synthetic
QVQLVQSGSEVKKPGSSVKVSCKASGGTLSLYAVSWVRQAPGQGLEWMGGIIPIFGTTKYAQEFQGRVTFSTDESTSTAYMELNSLRSEDTAVYYCARQWTMTRTLDFDIWGQGTLVTVSS

SEQ ID NO: 219 - DNA, 24 bp, Artificial Sequence
  synthetic
ggagggaccctcagcctctatgct

SEQ ID NO: 220 - protein, 8 aa, Artificial Sequence
  synthetic
GGTLSLYA

SEQ ID NO: 221 - DNA, 24 bp, Artificial Sequence
  synthetic
atcatccctatctttggtacaaca

SEQ ID NO: 222 - protein, 8 aa, Artificial Sequence
  synthetic
IIPIFGTT

SEQ ID NO: 223 - DNA, 42 bp, Artificial Sequence
  synthetic
gcgagacaatggactatgactagaaccttggattttgacatc

SEQ ID NO: 224 - protein, 14 aa, Artificial Sequence
  synthetic
ARQWTMTRTLDFDI

SEQ ID NO: 225 - DNA, 321 bp, Artificial Sequence
  synthetic
gacatccagatgacccagtctccatcctccctgtctgcatctgtaggagacagagtcaccatcacttgccggacaagtcagggcattagaaatgatttaggctggtatcagcagaaaccggggaaagcccctaagcgcctgatctatggtgcatccagtttgcaaagtggggtcccatcaagattcagcggcagtggatctgggacagaattcactctcacaatcagcagcctgcagcctgaagattttgcaagttattactgtctacaacataataattatccgtggacgttcggccaagggaccaaggtggaaatcaaa

SEQ ID NO: 226 - protein, 107 aa, Artificial Sequence
  synthetic
DIQMTQSPSSLSASVGDRVTITCRTSQGIRNDLGWYQQKPGKAPKRLIYGASSLQSGVPSRFSGSGSGTEFTLTISSLQPEDFASYYCLQHNNYPWTFGQGTKVEIK

SEQ ID NO: 227 - DNA, 18 bp, Artificial Sequence
  synthetic
cagggcattagaaatgat

SEQ ID NO: 228 - protein, 6 aa, Artificial Sequence
  synthetic
QGIRND

SEQ ID NO: 229 - DNA, 9 bp, Artificial Sequence
  synthetic
ggtgcatcc

SEQ ID NO: 230 - protein, 3 aa, Artificial Sequence
  synthetic
GAS

SEQ ID NO: 231 - DNA, 27 bp, Artificial Sequence
  synthetic
ctacaacataataattatccgtggacg

SEQ ID NO: 232 - protein, 9 aa, Artificial Sequence
  synthetic
LQHNNYPWT

SEQ ID NO: 233 - DNA, 369 bp, Artificial Sequence
  synthetic
caggtgcagctggtggagtctgggggaggcgtggtccagcctgggaggtccctgagactctcctgtgtagcctccggattcaccttcagtgtctatggcatgaactgggtccgccaggctccaggcaagggtctggactgggtggcagtcatatcaaatgatggaagttataaatactatgcggactccgtgaagggccgattcaccatctccagagacaattccaagaacacggtgtatctgcaaatgaacagcctgagaggtgaggacacggctatttattactgtgcgaaaaggaatgaatgggagctagaggaatactacggtatggacgtctggggccaagggaccacggtcaccgtctcctca

SEQ ID NO: 234 - protein, 123 aa, Artificial Sequence
  synthetic
QVQLVESGGGVVQPGRSLRLSCVASGFTFSVYGMNWVRQAPGKGLDWVAVISNDGSYKYYADSVKGRFTISRDNSKNTVYLQMNSLRGEDTAIYYCAKRNEWELEEYYGMDVWGQGTTVTVSS

SEQ ID NO: 235 - DNA, 24 bp, Artificial Sequence
  synthetic
ggattcaccttcagtgtctatggc

SEQ ID NO: 236 - protein, 8 aa, Artificial Sequence
  synthetic
GFTFSVYG

SEQ ID NO: 237 - DNA, 24 bp, Artificial Sequence
  synthetic
atatcaaatgatggaagttataaa

SEQ ID NO: 238 - protein, 8 aa, Artificial Sequence
  synthetic
ISNDGSYK

SEQ ID NO: 239 - DNA, 48 bp, Artificial Sequence
  synthetic
gcgaaaaggaatgaatgggagctagaggaatactacggtatggacgtc

SEQ ID NO: 240 - protein, 16 aa, Artificial Sequence
  synthetic
AKRNEWELEEYYGMDV

SEQ ID NO: 241 - DNA, 363 bp, Artificial Sequence
  synthetic
gaggtgcagctggtggagtctgggggaggattggtacagtctggagggtccctgagactctcctgtgtagcctctggattcaccttcaataattatgagatgaattgggtccgccaggctccagggaaggggctggagtggatttcatacattgatattaatggtggaagtaccatctactatgcagactctgtgaagggccgattcaccatctccagagacaatgccaagaagtcactgtatctgcaaatgaacagcctgagagccgaggacacggctatttactactgtgcgagcgcctttggttcgggtggttttctttttgactattggggccagggaaccctggtcactgtctcctca

SEQ ID NO: 242 - protein, 121 aa, Artificial Sequence
  synthetic
EVQLVESGGGLVQSGGSLRLSCVASGFTFNNYEMNWVRQAPGKGLEWISYIDINGGSTIYYADSVKGRFTISRDNAKKSLYLQMNSLRAEDTAIYYCASAFGSGGFLFDYWGQGTLVTVSS

SEQ ID NO: 243 - DNA, 24 bp, Artificial Sequence
  synthetic
ggattcaccttcaataattatgag

SEQ ID NO: 244 - protein, 8 aa, Artificial Sequence
  synthetic
GFTFNNYE

SEQ ID NO: 245 - DNA, 27 bp, Artificial Sequence
  synthetic
attgatattaatggtggaagtaccatc

SEQ ID NO: 246 - protein, 9 aa, Artificial Sequence
  synthetic
IDINGGSTI

SEQ ID NO: 247 - DNA, 39 bp, Artificial Sequence
  synthetic
gcgagcgcctttggttcgggtggttttctttttgactat

SEQ ID NO: 248 - protein, 13 aa, Artificial Sequence
  synthetic
ASAFGSGGFLFDY

SEQ ID NO: 249 - DNA, 366 bp, Artificial Sequence
  synthetic
caggtgcagctggtggagtctgggggaggcgtggtccagcctgggatgtccctgagactctcctgtatagcgtctggattcaccttcagtgactatgtcatacactgggtccgccaggctccaggcaaggggctggagtgggtggcaattatatggtatgatggaagtaataaatactatgcagactccgtgaagggccgattcaccatctccagagacaattccaagaacacgctgtatcttgaaatgaatagactgagagtcgaggacacggctgtgttttactgtgcgaggggtctggggatcgaagattacaattacggtatggacgtctggggccaagggaccacggtcaccgtctcctca

SEQ ID NO: 250 - protein, 122 aa, Artificial Sequence
  synthetic
QVQLVESGGGVVQPGMSLRLSCIASGFTFSDYVIHWVRQAPGKGLEWVAIIWYDGSNKYYADSVKGRFTISRDNSKNTLYLEMNRLRVEDTAVFYCARGLGIEDYNYGMDVWGQGTTVTVSS

SEQ ID NO: 251 - DNA, 24 bp, Artificial Sequence
  synthetic
ggattcaccttcagtgactatgtc

SEQ ID NO: 252 - protein, 8 aa, Artificial Sequence
  synthetic
GFTFSDYV

SEQ ID NO: 253 - DNA, 24 bp, Artificial Sequence
  synthetic
atatggtatgatggaagtaataaa

SEQ ID NO: 254 - protein, 8 aa, Artificial Sequence
  synthetic
IWYDGSNK

SEQ ID NO: 255 - DNA, 45 bp, Artificial Sequence
  synthetic
gcgaggggtctggggatcgaagattacaattacggtatggacgtc

SEQ ID NO: 256 - protein, 15 aa, Artificial Sequence
  synthetic
ARGLGIEDYNYGMDV

SEQ ID NO: 257 - DNA, 357 bp, Artificial Sequence
  synthetic
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacactggaccgacgaggatgcttttgatatctggggccaagggacaatggtcaccgtctcttca

SEQ ID NO: 258 - protein, 119 aa, Artificial Sequence
  synthetic
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHWTDEDAFDIWGQGTMVTVSS

SEQ ID NO: 259 - DNA, 24 bp, Artificial Sequence
  synthetic
ggatacagctttaccagctactgg

SEQ ID NO: 260 - protein, 8 aa, Artificial Sequence
  synthetic
GYSFTSYW

SEQ ID NO: 261 - DNA, 24 bp, Artificial Sequence
  synthetic
atctatcctggtgactctgatacc

SEQ ID NO: 262 - protein, 8 aa, Artificial Sequence
  synthetic
IYPGDSDT

SEQ ID NO: 263 - DNA, 36 bp, Artificial Sequence
  synthetic
gcgagacactggaccgacgaggatgcttttgatatc

SEQ ID NO: 264 - protein, 12 aa, Artificial Sequence
  synthetic
ARHWTDEDAFDI

SEQ ID NO: 265 - DNA, 369 bp, Artificial Sequence
  synthetic
caggtccagctggtgcagtctgggactgaggtgaagaagcctgggtcttcggtgaaggtctcctgcaaggcttctggaggcaccttcggcagttatcctatcagctgggtgcgacaggcccctggacaagggcttgagtggatgggagggatcatccctatctttggtacagcaaactccgcacagaagttccagggcagagtcacgattaccacggacgaacccacgagcacagccttcatggagctgagcagcctgagatctgaggacacggccgtgtattactgtgcgagaccgtattacgatattttgactgactactacggtatggacgtctggggtcaagggaccacggtcaccgtctcctca

SEQ ID NO: 266 - protein, 123 aa, Artificial Sequence
  synthetic
QVQLVQSGTEVKKPGSSVKVSCKASGGTFGSYPISWVRQAPGQGLEWMGGIIPIFGTANSAQKFQGRVTITTDEPTSTAFMELSSLRSEDTAVYYCARPYYDILTDYYGMDVWGQGTTVTVSS

SEQ ID NO: 267 - DNA, 24 bp, Artificial Sequence
  synthetic
ggaggcaccttcggcagttatcct

SEQ ID NO: 268 - protein, 8 aa, Artificial Sequence
  synthetic
GGTFGSYP

SEQ ID NO: 269 - DNA, 24 bp, Artificial Sequence
  synthetic
atcatccctatctttggtacagca

SEQ ID NO: 270 - protein, 8 aa, Artificial Sequence
  synthetic
IIPIFGTA

SEQ ID NO: 271 - DNA, 48 bp, Artificial Sequence
  synthetic
gcgagaccgtattacgatattttgactgactactacggtatggacgtc

SEQ ID NO: 272 - protein, 16 aa, Artificial Sequence
  synthetic
ARPYYDILTDYYGMDV

SEQ ID NO: 273 - DNA, 354 bp, Artificial Sequence
  synthetic
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccacggacgaatccacgagcacagcctacatggagctgagcagtctgagatctgaggacacggccgtgtattactgtgcgacagaagggtacaactggaactatgactattggggccagggaaccctggtcaccgtctcctca

SEQ ID NO: 274 - protein, 118 aa, Artificial Sequence
  synthetic
QVQLVQSGAEVKKPGSSVKVSCKASGGTFSSYAISWVRQAPGQGLEWMGGIIPIFGTANYAQKFQGRVTITTDESTSTAYMELSSLRSEDTAVYYCATEGYNWNYDYWGQGTLVTVSS

SEQ ID NO: 275 - DNA, 24 bp, Artificial Sequence
  synthetic
ggaggcaccttcagcagctatgct

SEQ ID NO: 276 - protein, 8 aa, Artificial Sequence
  synthetic
GGTFSSYA

SEQ ID NO: 277 - DNA, 24 bp, Artificial Sequence
  synthetic
atcatccctatctttggtacagca

SEQ ID NO: 278 - protein, 8 aa, Artificial Sequence
  synthetic
IIPIFGTA

SEQ ID NO: 279 - DNA, 33 bp, Artificial Sequence
  synthetic
gcgacagaagggtacaactggaactatgactat

SEQ ID NO: 280 - protein, 11 aa, Artificial Sequence
  synthetic
ATEGYNWNYDY

SEQ ID NO: 281 - DNA, 363 bp, Artificial Sequence
  synthetic
caggtccagctggtgcagtctggggctgaggtgaagaagcctgggtcctcggtgaaggtctcctgcaaggcttctggaggcaccttcagcagctatgttatcacctgggtgcgacaggtccctggacaagggcttgagtggatgggagggatcatccctatctttggtacagcaaactacgcacagaagttccagggcagagtcacgattaccacggacgaatccacgagcacagcctacatggacctgagcagcctgagatctgaggacacggccttttattattgtgcgagaaggaggtctaactggggatctcatgcttttgatatctggggccaagggacaatggtcaccgtctcttca

SEQ ID NO: 282 - protein, 121 aa, Artificial Sequence
  synthetic
QVQLVQSGAEVKKPGSSVKVSCKASGGTFSSYVITWVRQVPGQGLEWMGGIIPIFGTANYAQKFQGRVTITTDESTSTAYMDLSSLRSEDTAFYYCARRRSNWGSHAFDIWGQGTMVTVSS

SEQ ID NO: 283 - DNA, 24 bp, Artificial Sequence
  synthetic
ggaggcaccttcagcagctatgtt

SEQ ID NO: 284 - protein, 8 aa, Artificial Sequence
  synthetic
GGTFSSYV

SEQ ID NO: 285 - DNA, 24 bp, Artificial Sequence
  synthetic
atcatccctatctttggtacagca

SEQ ID NO: 286 - protein, 8 aa, Artificial Sequence
  synthetic
IIPIFGTA

SEQ ID NO: 287 - DNA, 42 bp, Artificial Sequence
  synthetic
gcgagaaggaggtctaactggggatctcatgcttttgatatc

SEQ ID NO: 288 - protein, 14 aa, Artificial Sequence
  synthetic
ARRRSNWGSHAFDI

SEQ ID NO: 289 - DNA, 387 bp, Artificial Sequence
  synthetic
gaagtgcagctggtggagtctgggggaggcttggtacagcctggcaggtccctgagactctcctgtgcagcctctggaatcacctttgatgattatgccatgtactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagttgaggacacggccttgtattattgtgcaaaagataaggggtattacgatattttgactggagattactactactactacggtatggacgtctggggccaagggaccacggtcaccgtctcctca

SEQ ID NO: 290 - protein, 129 aa, Artificial Sequence
  synthetic
EVQLVESGGGLVQPGRSLRLSCAASGITFDDYAMYWVRQAPGKGLEWVSGISWNSGSIGYADSVKGRFTISRDNAKNSLYLQMNSLRVEDTALYYCAKDKGYYDILTGDYYYYYGMDVWGQGTTVTVSS

SEQ ID NO: 291 - DNA, 24 bp, Artificial Sequence
  synthetic
ggaatcacctttgatgattatgcc

SEQ ID NO: 292 - protein, 8 aa, Artificial Sequence
  synthetic
GITFDDYA

SEQ ID NO: 293 - DNA, 24 bp, Artificial Sequence
  synthetic
attagttggaatagtggtagcata

SEQ ID NO: 294 - protein, 8 aa, Artificial Sequence
  synthetic
ISWNSGSI

SEQ ID NO: 295 - DNA, 66 bp, Artificial Sequence
  synthetic
gcaaaagataaggggtattacgatattttgactggagattactactactactacggtatggacgtc

SEQ ID NO: 296 - protein, 22 aa, Artificial Sequence
  synthetic
AKDKGYYDILTGDYYYYYGMDV

SEQ ID NO: 297 - DNA, 354 bp, Artificial Sequence
  synthetic
gaggtgcagctggtggagtctgggggaagcttggtacagcctggggggtccctcagactctcctgtgcagcctctggattcacctttagcatctctgccatgagctgggtccgccaggctccagggaaggggctggagtgggtctcagctattagtagtagtggtgttagcacatactacgcagactccgtgaagggccggttcaccatctccagagacaattccaagaacacgctgtatctgcaaatgaacagcctgagagccgatgacacggccgtatattactgtgcgaaagggagcagctggtactacttcgactactggggccagggaaccacggtcaccgtctcctca

SEQ ID NO: 298 - protein, 118 aa, Artificial Sequence
  synthetic
EVQLVESGGSLVQPGGSLRLSCAASGFTFSISAMSWVRQAPGKGLEWVSAISSSGVSTYYADSVKGRFTISRDNSKNTLYLQMNSLRADDTAVYYCAKGSSWYYFDYWGQGTTVTVSS

SEQ ID NO: 299 - DNA, 24 bp, Artificial Sequence
  synthetic
ggattcacctttagcatctctgcc

SEQ ID NO: 300 - protein, 8 aa, Artificial Sequence
  synthetic
GFTFSISA

SEQ ID NO: 301 - DNA, 24 bp, Artificial Sequence
  synthetic
attagtagtagtggtgttagcaca

SEQ ID NO: 302 - protein, 8 aa, Artificial Sequence
  synthetic
ISSSGVST

SEQ ID NO: 303 - DNA, 33 bp, Artificial Sequence
  synthetic
gcgaaagggagcagctggtactacttcgactac

SEQ ID NO: 304 - protein, 11 aa, Artificial Sequence
  synthetic
AKGSSWYYFDY

SEQ ID NO: 305 - DNA, 327 bp, Artificial Sequence
  synthetic
gacatcgtgatgacccagtctccaggcattctgtctttgtctccaggggaaagagccaccctctcctgcagggccagtcagagtgttagcagcagctacttagcctggtaccagcagaaacctggccaggctcccagactcctcatctatggtgcatccagcagggccactggcatcccagacaggttcagtggcagtgggtctgggacagacttcactctcaccatcagcagactggaccctgaagattttgcagtgtattactgtcagcagtatggtagctcacactacacttttggccaggggaccaaggtggagatcaaacga

SEQ ID NO: 306 - protein, 109 aa, Artificial Sequence
  synthetic
DIVMTQSPGILSLSPGERATLSCRASQSVSSSYLAWYQQKPGQAPRLLIYGASSRATGIPDRFSGSGSGTDFTLTISRLDPEDFAVYYCQQYGSSHYTFGQGTKVEIKR

SEQ ID NO: 307 - DNA, 21 bp, Artificial Sequence
  synthetic
cagagtgttagcagcagctac

SEQ ID NO: 308 - protein, 7 aa, Artificial Sequence
  synthetic
QSVSSSY

SEQ ID NO: 309 - DNA, 9 bp, Artificial Sequence
  synthetic
ggtgcatcc

SEQ ID NO: 310 - protein, 3 aa, Artificial Sequence
  synthetic
GAS

SEQ ID NO: 311 - DNA, 27 bp, Artificial Sequence
  synthetic
cagcagtatggtagctcacactacact

SEQ ID NO: 312 - protein, 9 aa, Artificial Sequence
  synthetic
QQYGSSHYT

SEQ ID NO: 313 - DNA, 366 bp, Artificial Sequence
  synthetic
gaggtgcagctggtggagtcgggcccaggactggtgaagccttcggagagcctgtccctcacctgcactgtctctggtggctccatcagtagttactattggagctggatccggcagcccccagggaagggactggagtggattgggtatatctatcacagtgggaggaccaactacaacccctccctcaagagtcgagtcaccatatcagtagacacgtccaagaaccagttctccctgaagctggactctgtgaccgctgcggacacggccgtgtattactgtgcgagagggggcagctcgtccctctactactactatggtatggacgtctggggccaagggaccacggtcaccgtctcctca

SEQ ID NO: 314 - protein, 122 aa, Artificial Sequence
  synthetic
EVQLVESGPGLVKPSESLSLTCTVSGGSISSYYWSWIRQPPGKGLEWIGYIYHSGRTNYNPSLKSRVTISVDTSKNQFSLKLDSVTAADTAVYYCARGGSSSLYYYYGMDVWGQGTTVTVSS

SEQ ID NO: 315 - DNA, 24 bp, Artificial Sequence
  synthetic
ggtggctccatcagtagttactat

SEQ ID NO: 316 - protein, 8 aa, Artificial Sequence
  synthetic
GGSISSYY

SEQ ID NO: 317 - DNA, 21 bp, Artificial Sequence
  synthetic
atctatcacagtgggaggacc

SEQ ID NO: 318 - protein, 7 aa, Artificial Sequence
  synthetic
IYHSGRT

SEQ ID NO: 319 - DNA, 48 bp, Artificial Sequence
  synthetic
gcgagagggggcagctcgtccctctactactactatggtatggacgtc

SEQ ID NO: 320 - protein, 16 aa, Artificial Sequence
  synthetic
ARGGSSSLYYYYGMDV

SEQ ID NO: 321 - DNA, 324 bp, Artificial Sequence
  synthetic
gacatcctgatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtggacgttcggccaagggaccaaggtggagatcaaacga

SEQ ID NO: 322 - protein, 108 aa, Artificial Sequence
  synthetic
DILMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIKR

SEQ ID NO: 323 - DNA, 18 bp, Artificial Sequence
  synthetic
cagggcattagaaatgat

SEQ ID NO: 324 - protein, 6 aa, Artificial Sequence
  synthetic
QGIRND

SEQ ID NO: 325 - DNA, 9 bp, Artificial Sequence
  synthetic
gctgcatcc

SEQ ID NO: 326 - protein, 3 aa, Artificial Sequence
  synthetic
AAS

SEQ ID NO: 327 - DNA, 27 bp, Artificial Sequence
  synthetic
ctacagcataatagttacccgtggacg

SEQ ID NO: 328 - protein, 9 aa, Artificial Sequence
  synthetic
LQHNSYPWT

SEQ ID NO: 329 - DNA, 354 bp, Artificial Sequence
  synthetic
caggtgcagctggtggagtctgggggaggcgtggtccagcctgggaggtccctgagactctcctgtgcagcgtctggattcacgttcagcaactatggcatgcactgggtccgccaggctccaggcaaggggctggagtgggtggcatcgatatggtatgatggaagtaataaaaactatgcagactccgtgaagggtcgattcaccatctccagagacaatcctaagaacacgctgcatctgcaaatgagcagcctgagagccgaggacacggctatctattattgtgcgacagagatagcagctcgtccttttgagtactggggccagggaatcctggtcaccgtctcctca

SEQ ID NO: 330 - protein, 118 aa, Artificial Sequence
  synthetic
QVQLVESGGGVVQPGRSLRLSCAASGFTFSNYGMHWVRQAPGKGLEWVASIWYDGSNKNYADSVKGRFTISRDNPKNTLHLQMSSLRAEDTAIYYCATEIAARPFEYWGQGILVTVSS

SEQ ID NO: 331 - DNA, 24 bp, Artificial Sequence
  synthetic
ggattcacgttcagcaactatggc

SEQ ID NO: 332 - protein, 8 aa, Artificial Sequence
  synthetic
GFTFSNYG

SEQ ID NO: 333 - DNA, 24 bp, Artificial Sequence
  synthetic
atatggtatgatggaagtaataaa

SEQ ID NO: 334 - protein, 8 aa, Artificial Sequence
  synthetic
IWYDGSNK

SEQ ID NO: 335 - DNA, 33 bp, Artificial Sequence
  synthetic
gcgacagagatagcagctcgtccttttgagtac

SEQ ID NO: 336 - protein, 11 aa, Artificial Sequence
  synthetic
ATEIAARPFEY

SEQ ID NO: 337 - DNA, 324 bp, Artificial Sequence
  synthetic
gacatcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaaacga

SEQ ID NO: 338 - protein, 108 aa, Artificial Sequence
  synthetic
DIVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR

SEQ ID NO: 339 - DNA, 18 bp, Artificial Sequence
  synthetic
cagagcattagcagctat

SEQ ID NO: 340 - protein, 6 aa, Artificial Sequence
  synthetic
QSISSY

SEQ ID NO: 341 - DNA, 9 bp, Artificial Sequence
  synthetic
gctgcatcc

SEQ ID NO: 342 - protein, 3 aa, Artificial Sequence
  synthetic
AAS

SEQ ID NO: 343 - DNA, 27 bp, Artificial Sequence
  synthetic
caacagagttacagtacccctctcact

SEQ ID NO: 344 - protein, 9 aa, Artificial Sequence
  synthetic
QQSYSTPLT

SEQ ID NO: 345 - DNA, 372 bp, Artificial Sequence
  synthetic
gaggtgcagctggtggagtctgggggaggcttggtccagcctggggggtccctgagactctcctgtgcagcctctggattcacttttagaagctattggatgaactgggtccgccaggctccagggaaggggctggagtgggtggccgacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagatcccattacgatttttggagtggttgggactacggtatggacgtctggggccaagggaccacggtcaccgtctcctca

SEQ ID NO: 346 - protein, 124 aa, Artificial Sequence
  synthetic
EVQLVESGGGLVQPGGSLRLSCAASGFTFRSYWMNWVRQAPGKGLEWVADIKQDGSEKYYVDSVKGRFTISRDNAKNSLYLQMNSLRAEDTAVYYCARSHYDFWSGWDYGMDVWGQGTTVTVSS

SEQ ID NO: 347 - DNA, 24 bp, Artificial Sequence
  synthetic
ggattcacttttagaagctattgg

SEQ ID NO: 348 - protein, 8 aa, Artificial Sequence
  synthetic
GFTFRSYW

SEQ ID NO: 349 - DNA, 24 bp, Artificial Sequence
  synthetic
ataaagcaagatggaagtgagaaa

SEQ ID NO: 350 - protein, 8 aa, Artificial Sequence
  synthetic
IKQDGSEK

SEQ ID NO: 351 - DNA, 51 bp, Artificial Sequence
  synthetic
gcgagatcccattacgatttttggagtggttgggactacggtatggacgtc

SEQ ID NO: 352 - protein, 17 aa, Artificial Sequence
  synthetic
ARSHYDFWSGWDYGMDV

SEQ ID NO: 353 - DNA, 322 bp, Artificial Sequence
  synthetic
gacatcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcactttcggcggagggaccaaggtggagatcaaacga

SEQ ID NO: 354 - protein, 107 aa, Artificial Sequence
  synthetic
DIVMTQSPSSLSASVGDRVTITCRASQSISSYLNWYQQKPGKAPKLLIYAASSLQSGVPSRFSGSGSGTDFTLTISSLQPEDFATYYCQQSYSTPHFRRRDQGGDQT

SEQ ID NO: 355 - DNA, 18 bp, Artificial Sequence
  synthetic
cagagcattagcagctat

SEQ ID NO: 356 - protein, 6 aa, Artificial Sequence
  synthetic
QSISSY

SEQ ID NO: 357 - DNA, 9 bp, Artificial Sequence
  synthetic
gctgcatcc

SEQ ID NO: 358 - protein, 3 aa, Artificial Sequence
  synthetic
AAS

SEQ ID NO: 359 - DNA, 9 bp, Artificial Sequence
  synthetic
caacagagt

SEQ ID NO: 360 - protein, 3 aa, Artificial Sequence
  synthetic
QQS

SEQ ID NO: 361 - DNA, 354 bp, Artificial Sequence
  synthetic
gaggtgcagctggtggagtctgggggaggcgtggtccagtctgggaggtccctgagactttcctgtgcagcgtctggattcaccttcagtaactatggcatgcactgggtccgccaggctccaggcaaggggctggactgggtggcacttatatggcttgatggaagtcatgaaaactatgcagactccgtgaagggccgattcaccatatccagagacaattccaagaacacactatttctgcaaatgaacaacctgagagccgaggacacggctgtgtactactgtgcgacagagatagcagctcgtccttttgagtactggggccagggaaccacggtcaccgtctcctca

SEQ ID NO: 362 - protein, 118 aa, Artificial Sequence
  synthetic
EVQLVESGGGVVQSGRSLRLSCAASGFTFSNYGMHWVRQAPGKGLDWVALIWLDGSHENYADSVKGRFTISRDNSKNTLFLQMNNLRAEDTAVYYCATEIAARPFEYWGQGTTVTVSS

SEQ ID NO: 363 - DNA, 24 bp, Artificial Sequence
  synthetic
ggattcaccttcagtaactatggc

SEQ ID NO: 364 - protein, 8 aa, Artificial Sequence
  synthetic
GFTFSNYG

SEQ ID NO: 365 - DNA, 24 bp, Artificial Sequence
  synthetic
atatggcttgatggaagtcatgaa

SEQ ID NO: 366 - protein, 8 aa, Artificial Sequence
  synthetic
IWLDGSHE

SEQ ID NO: 367 - DNA, 33 bp, Artificial Sequence; identical to SEQ ID NO: 335
  synthetic

SEQ ID NO: 368 - protein, 11 aa, Artificial Sequence
  synthetic
ATEIAARPFEY

SEQ ID NO: 369 - DNA, 324 bp, Artificial Sequence
  synthetic
gacatcctgatgacccagtctccatcctccctgtctacatctgtaggagacagagtcaccatcacttgccgggcaagtcagagcattagcacctatttaaattggtatcagcagaaaccagggaaagcccctaaactcctgatctatgctgcatccagtttgcaaagtggggtcccgtcaaggttcagtggcagtggatctgggacagatttcactctcaccgtcagcagtctgcaacctgaagattttgcaacttactactgtcaacagagttacatttcccctctcactgtcggccctgggaccaaggtggagatcaaacga

SEQ ID NO: 370 - protein, 108 aa, Artificial Sequence
  synthetic
DILMTQSPSSLSTSVGDRVTITCRASQSISTYLNWYQQKPGKAPKLLIYAASSLQSGVPSRFSGSGSGTDFTLTVSSLQPEDFATYYCQQSYISPLTVGPGTKVEIKR

SEQ ID NO: 371 - DNA, 18 bp, Artificial Sequence
  synthetic
cagagcattagcacctat

SEQ ID NO: 372 - protein, 6 aa, Artificial Sequence
  synthetic
QSISTY

SEQ ID NO: 373 - DNA, 9 bp, Artificial Sequence
  synthetic
gctgcatcc

SEQ ID NO: 374 - protein, 3 aa, Artificial Sequence
  synthetic
AAS

SEQ ID NO: 375 - DNA, 27 bp, Artificial Sequence
  synthetic
caacagagttacatttcccctctcact

SEQ ID NO: 376 - protein, 9 aa, Artificial Sequence
  synthetic
QQSYISPLT

SEQ ID NO: 377 - DNA, 354 bp, Artificial Sequence
  synthetic
gaggtgcagctggtggagtctgggggaggcttggtacagtctggggggtccctgagactctcctgtgcagcctctggatttaccttcagcacttatgccatgagctgggtccgccaggctccagggaaggggctggagtgggtctcagctattagtagtagcggtgttagcacacactacgcagactccgtgaagggccggttcaccatctccagagacaattccaagaacacgctgtatctgcaagtgaacagcctgagagccgaggacacggccgtatatttttgtgctaaagggagtgcctggtactacttcgacttctggggccagggaaccctggtcaccgtctcctca

SEQ ID NO: 378 - protein, 118 aa, Artificial Sequence
  synthetic
EVQLVESGGGLVQSGGSLRLSCAASGFTFSTYAMSWVRQAPGKGLEWVSAISSSGVSTHYADSVKGRFTISRDNSKNTLYLQVNSLRAEDTAVYFCAKGSAWYYFDFWGQGTLVTVSS

SEQ ID NO: 379 - DNA, 24 bp, Artificial Sequence
  synthetic
ggatttaccttcagcacttatgcc

SEQ ID NO: 380 - protein, 8 aa, Artificial Sequence
  synthetic
GFTFSTYA

SEQ ID NO: 381 - DNA, 24 bp, Artificial Sequence
  synthetic
attagtagtagcggtgttagcaca

SEQ ID NO: 382 - protein, 8 aa, Artificial Sequence
  synthetic
ISSSGVST

SEQ ID NO: 383 - DNA, 33 bp, Artificial Sequence
  synthetic
gctaaagggagtgcctggtactacttcgacttc

SEQ ID NO: 384 - protein, 11 aa, Artificial Sequence
  synthetic
AKGSAWYYFDF

SEQ ID NO: 385 - DNA, 327 bp, Artificial Sequence
  synthetic
gacatcgtgatgacccagtctccaggcaccctgtctttgtctccaggggaaagagccaccctctcctgcagggccagtcagagtgttagcagcagctacttagcctggtaccagcagaaaactggccaggctcccaggctcctcatctatggtgcatccagcagggccactggcatcccagacaggttcagtggcagtgggtctgggacagacttcactctcaccatcagcagactggagcctgaagattttgcagtgtattcctgtcaacagtatggtggctcaccgatcaccttcggccaagggacacgactggagattaaacga

SEQ ID NO: 386 - protein, 109 aa, Artificial Sequence
  synthetic
DIVMTQSPGTLSLSPGERATLSCRASQSVSSSYLAWYQQKTGQAPRLLIYGASSRATGIPDRFSGSGSGTDFTLTISRLEPEDFAVYSCQQYGGSPITFGQGTRLEIKR

SEQ ID NO: 387 - DNA, 21 bp, Artificial Sequence
  synthetic
cagagtgttagcagcagctac

SEQ ID NO: 388 - protein, 7 aa, Artificial Sequence
  synthetic
QSVSSSY

SEQ ID NO: 389 - DNA, 9 bp, Artificial Sequence
  synthetic
ggtgcatcc

SEQ ID NO: 390 - protein, 3 aa, Artificial Sequence
  synthetic
GAS

SEQ ID NO: 391 - DNA, 27 bp, Artificial Sequence
  synthetic
caacagtatggtggctcaccgatcacc

SEQ ID NO: 392 - protein, 9 aa, Artificial Sequence
  synthetic
QQYGGSPIT

SEQ ID NO: 393 - DNA, 387 bp, Artificial Sequence
  synthetic
gaggtgcagctggtggagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagataactatgatagtagtggttattactacgttaactactactactacggtatggacgtctggggccaagggaccacggtcaccgtctcctca

SEQ ID NO: 394 - protein, 129 aa, Artificial Sequence
  synthetic
EVQLVESGGGVVQPGGSLRLSCAASGFTFDDYAMHWVRQAPGKGLEWVSLISGDGGSTYYADSVKGRFTISRDNSKNSLYLQMNSLRTEDTALYYCAKDNYDSSGYYYVNYYYYGMDVWGQGTTVTVSS

SEQ ID NO: 395 - DNA, 24 bp, Artificial Sequence
  synthetic
ggattcacctttgatgattatgcc

SEQ ID NO: 396 - protein, 8 aa, Artificial Sequence
  synthetic
GFTFDDYA

SEQ ID NO: 397 - DNA, 24 bp, Artificial Sequence
  synthetic
attagtggggatggtggtagcaca

SEQ ID NO: 398 - protein, 8 aa, Artificial Sequence
  synthetic
ISGDGGST

SEQ ID NO: 399 - DNA, 66 bp, Artificial Sequence
  synthetic
gcaaaagataactatgatagtagtggttattactacgttaactactactactacggtatggacgtc

SEQ ID NO: 400 - protein, 22 aa, Artificial Sequence
  synthetic
AKDNYDSSGYYYVNYYYYGMDV

SEQ ID NO: 401 - DNA, 324 bp, Artificial Sequence
  synthetic
gaaatcgtgatgacccagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatctcacctcgattcagtggcagcgggtatggaacagattttaccctcacaattaataacatagaatctgaggatgctgcatattacttctgtctacaacatgataatttcccgtacacttttggccaggggaccaaggtggagatcaaacga

SEQ ID NO: 402 - protein, 108 aa, Artificial Sequence
  synthetic
EIVMTQSPAFMSATPGDKVNISCKASQDIDDDMNWYQQKPGEAAIFIIQEATTLVPGISPRFSGSGYGTDFTLTINNIESEDAAYYFCLQHDNFPYTFGQGTKVEIKR

SEQ ID NO: 403 - DNA, 18 bp, Artificial Sequence
  synthetic
caagacattgatgatgat

SEQ ID NO: 404 - protein, 6 aa, Artificial Sequence
  synthetic
QDIDDD

SEQ ID NO: 405 - DNA, 9 bp, Artificial Sequence
  synthetic
gaagctact

SEQ ID NO: 406 - protein, 3 aa, Artificial Sequence
  synthetic
EAT

SEQ ID NO: 407 - DNA, 27 bp, Artificial Sequence
  synthetic
ctacaacatgataatttcccgtacact

SEQ ID NO: 408 - protein, 9 aa, Artificial Sequence
  synthetic
LQHDNFPYT

SEQ ID NO: 409 - DNA, 354 bp, Artificial Sequence
  synthetic
gaggtgcagctggtggagtctgggggaggcgtggtccagcctgggaggtccctgagactctcctgtgcagcgtctgggttcaccttcagtaattatggcatgcactgggtccgccaggctccaggcaaggggctggagtgggtggcacttatatggtatgatggaagtaataaaaactatacagagtccgtgaagggccgattcaccatctccagagacaattccgaaaacacactgtatctgcaaatgaacagcctgagagccgaggacacggctgtgtatttctgtgcgagcgagatcgcagctcgtccttttgagtattggggccagggaaccatggtcaccgtctcctca

SEQ ID NO: 410 - protein, 118 aa, Artificial Sequence
  synthetic
EVQLVESGGGVVQPGRSLRLSCAASGFTFSNYGMHWVRQAPGKGLEWVALIWYDGSNKNYTESVKGRFTISRDNSENTLYLQMNSLRAEDTAVYFCASEIAARPFEYWGQGTMVTVSS

SEQ ID NO: 411 - DNA, 24 bp, Artificial Sequence
  synthetic
gggttcaccttcagtaattatggc

SEQ ID NO: 412 - protein, 8 aa, Artificial Sequence
  synthetic
GFTFSNYG

SEQ ID NO: 413 - DNA, 24 bp, Artificial Sequence
  synthetic
atatggtatgatggaagtaataaa

SEQ ID NO: 414 - protein, 8 aa, Artificial Sequence
  synthetic
IWYDGSNK

SEQ ID NO: 415 - DNA, 33 bp, Artificial Sequence
  synthetic
gcgagcgagatcgcagctcgtccttttgagtat

SEQ ID NO: 416 - protein, 11 aa, Artificial Sequence
  synthetic
ASEIAARPFEY

SEQ ID NO: 417 - DNA, 324 bp, Artificial Sequence
  synthetic
gacatcctgatgacccagtctccatcctccctgtctgcatctgtaggagacagagtcaccatcacttgccgggctagtcagagcattagcaactatttagattggtatcagcagaaaccagggaaagcccctaagctcctgatctatgctgcatccaatttggaaactggggtcccatcaaggttcagtggcagtggatctgggacagattttactctcaccatcagcagcctgcagcctgaagattttgcaacttattactgtcaacaggctaacaatttcccgtacacttttggccaggggaccaaggtggagatcaaacga

SEQ ID NO: 418 - protein, 108 aa, Artificial Sequence
  synthetic
DILMTQSPSSLSASVGDRVTITCRASQSISNYLDWYQQKPGKAPKLLIYAASNLETGVPSRFSGSGSGTDFTLTISSLQPEDFATYYCQQANNFPYTFGQGTKVEIKR

SEQ ID NO: 419 - DNA, 18 bp, Artificial Sequence
  synthetic
cagagcattagcaactat

SEQ ID NO: 420 - protein, 6 aa, Artificial Sequence
  synthetic
QSISNY

SEQ ID NO: 421 - DNA, 9 bp, Artificial Sequence
  synthetic
gctgcatcc

SEQ ID NO: 422 - protein, 3 aa, Artificial Sequence
  synthetic
AAS

SEQ ID NO: 423 - DNA, 27 bp, Artificial Sequence
  synthetic
caacaggctaacaatttcccgtacact

SEQ ID NO: 424 - protein, 9 aa, Artificial Sequence
  synthetic
QQANNFPYT

SEQ ID NO: 425 - DNA, 354 bp, Artificial Sequence
  synthetic
gaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcacttatatggtttgatggaagtaataaaaactatacagactccgtgaagggtcgattcaccatctccagagacaattccaagaacacgctgtatctgcaaatgagtagcctgagagccgaagacacggctgtgtattattgtgcgacagagatagcagctcgtccttttgagtactggggccagggaaccctggtcaccgtctcctca

SEQ ID NO: 426 - protein, 118 aa, Artificial Sequence
  synthetic
EVQLVESGGGVVQPGRSLRLSCAASGFTFSSYGMHWVRQAPGKGLEWVALIWFDGSNKNYTDSVKGRFTISRDNSKNTLYLQMSSLRAEDTAVYYCATEIAARPFEYWGQGTLVTVSS

SEQ ID NO: 427 - DNA, 24 bp, Artificial Sequence
  synthetic
ggattcaccttcagtagctatggc

SEQ ID NO: 428 - protein, 8 aa, Artificial Sequence
  synthetic
GFTFSSYG

SEQ ID NO: 429 - DNA, 24 bp, Artificial Sequence
  synthetic
atatggtttgatggaagtaataaa

SEQ ID NO: 430 - protein, 8 aa, Artificial Sequence
  synthetic
IWFDGSNK

SEQ ID NO: 431 - DNA, 33 bp, Artificial Sequence; identical to SEQ ID NO: 335
  synthetic

SEQ ID NO: 432 - protein, 11 aa, Artificial Sequence
  synthetic
ATEIAARPFEY

SEQ ID NO: 433 - DNA, 324 bp, Artificial Sequence
  synthetic
gacatcgtgatgacccagtctccatccttcctgtctgcatctgtaggagacagagtcaccatcacttgctgggccagtcagggcattagcagttatttagcctggtatcagcaaaaaccagggaaagcccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaataattaccctcacacttttggccaggggaccaaggtggagatcaaacga

SEQ ID NO: 434 - protein, 108 aa, Artificial Sequence
  synthetic
DIVMTQSPSFLSASVGDRVTITCWASQGISSYLAWYQQKPGKAPKLLIYVASTLQSGVPSRFSGSGSGTEFTLTISSLQPEDFATYYCQQLNNYPHTFGQGTKVEIKR

SEQ ID NO: 435 - DNA, 18 bp, Artificial Sequence
  synthetic
cagggcattagcagttat

SEQ ID NO: 436 - protein, 6 aa, Artificial Sequence
  synthetic
QGISSY

SEQ ID NO: 437 - DNA, 9 bp, Artificial Sequence
  synthetic
gttgcatcc

SEQ ID NO: 438 - protein, 3 aa, Artificial Sequence
  synthetic
VAS

SEQ ID NO: 439 - DNA, 27 bp, Artificial Sequence
  synthetic
caacagcttaataattaccctcacact

SEQ ID NO: 440 - protein, 9 aa, Artificial Sequence
  synthetic
QQLNNYPHT

SEQ ID NO: 441 - DNA, 354 bp, Artificial Sequence
  synthetic
gaggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcactaatatggtatgatggaagtaataaaaactatacagactccgtgaagggtcgattcaccatatccagagacaattccaagaacacactgtatctccaaatgagcagcctgagagccgaagacacggctgtatattattgtgcgacagaaatagcagctcgtccttttgaatattggggccagggaaccatggtcaccgtctcctca

SEQ ID NO: 442 - protein, 118 aa, Artificial Sequence
  synthetic
EVQLVESGGGVVQPGRSLRLSCAASGFTFSNYGMHWVRQAPGKGLEWVALIWYDGSNKNYTDSVKGRFTISRDNSKNTLYLQMSSLRAEDTAVYYCATEIAARPFEYWGQGTMVTVSS

SEQ ID NO: 443 - DNA, 24 bp, Artificial Sequence
  synthetic
ggattcaccttcagtaactatggc

SEQ ID NO: 444 - protein, 8 aa, Artificial Sequence
  synthetic
GFTFSNYG

SEQ ID NO: 445 - DNA, 24 bp, Artificial Sequence
  synthetic
atatggtatgatggaagtaataaa

SEQ ID NO: 446 - protein, 8 aa, Artificial Sequence
  synthetic
IWYDGSNK

SEQ ID NO: 447 - DNA, 33 bp, Artificial Sequence
  synthetic
gcgacagaaatagcagctcgtccttttgaatat

SEQ ID NO: 448 - protein, 11 aa, Artificial Sequence
  synthetic
ATEIAARPFEY

SEQ ID NO: 449 - DNA, 324 bp, Artificial Sequence
  synthetic
gacatcgtgctgacccagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatctcacctcgattcagtggcagcgggtatggaacagattttaccctcacaattaataacatagaatctgaggatgctgcatattacttctgtctacaacatgataatttcccgtacacttttggccaggggaccaaggtggagatcaaacga

SEQ ID NO: 450 - protein, 108 aa, Artificial Sequence
  synthetic
DIVLTQSPAFMSATPGDKVNISCKASQDIDDDMNWYQQKPGEAAIFIIQEATTLVPGISPRFSGSGYGTDFTLTINNIESEDAAYYFCLQHDNFPYTFGQGTKVEIKR

SEQ ID NO: 451 - DNA, 18 bp, Artificial Sequence
  synthetic
caagacattgatgatgat

SEQ ID NO: 452 - protein, 6 aa, Artificial Sequence
  synthetic
QDIDDD

SEQ ID NO: 453 - DNA, 9 bp, Artificial Sequence
  synthetic
gaagctact

SEQ ID NO: 454 - protein, 3 aa, Artificial Sequence
  synthetic
EAT

SEQ ID NO: 455 - DNA, 27 bp, Artificial Sequence
  synthetic
ctacaacatgataatttcccgtacact

SEQ ID NO: 456 - protein, 9 aa, Artificial Sequence
  synthetic
LQHDNFPYT

SEQ ID NO: 457 - DNA, 384 bp, Artificial Sequence
  synthetic
gaggtgcagctggtggagtctgggggaggtgtggtacggcctggggggtccctgagactctcctgtgcagcctctggattcacctttgctgattatggaatgaactgggtccgccaagttccagggaagggactggagtgggtctctggtattaattataagggtgatagtacaaattatgcagactctgtgaagggccgattcaccatctccagagacaacgccaagaactccctgtatctgcaaatgaacaatcttagagccgaggacacggccttgtatcactgtgcgagagaaatttattgtattaatggtgtatgttatacggactactactacggtatggacgtctggggccaagggaccacggtcaccgtctcctca

SEQ ID NO: 458 - protein, 128 aa, Artificial Sequence
  synthetic
EVQLVESGGGVVRPGGSLRLSCAASGFTFADYGMNWVRQVPGKGLEWVSGINYKGDSTNYADSVKGRFTISRDNAKNSLYLQMNNLRAEDTALYHCAREIYCINGVCYTDYYYGMDVWGQGTTVTVSS

SEQ ID NO: 459 - DNA, 24 bp, Artificial Sequence
  synthetic
ggattcacctttgctgattatgga

SEQ ID NO: 460 - protein, 8 aa, Artificial Sequence
  synthetic
GFTFADYG

SEQ ID NO: 461 - DNA, 24 bp, Artificial Sequence
  synthetic
attaattataagggtgatagtaca

SEQ ID NO: 462 - protein, 8 aa, Artificial Sequence
  synthetic
INYKGDST

SEQ ID NO: 463 - DNA, 63 bp, Artificial Sequence
  synthetic
gcgagagaaatttattgtattaatggtgtatgttatacggactactactacggtatggacgtc

SEQ ID NO: 464 - protein, 21 aa, Artificial Sequence
  synthetic
AREIYCINGVCYTDYYYGMDV

SEQ ID NO: 465 - DNA, 324 bp, Artificial Sequence
  synthetic
gacatcctgatgacccagtctccatcttccctgtctgcatctgtaggagacagagtcaccatcacttgccgggcaaggcagagcattaacagctatttaaattggtatcaacagaaaccagggaaagcccctaaactcctcatctatgttgcatccagtttgcaaagcggggtcccatcaaggttcagcggcagtggatctgggacagatttcactctcaccatcaacagtctgcagcctgaggatttcgcaatttatttctgtcaacagagttacagtaccccgatcaccttcggccaagggaccaaactggagatcaaacga

SEQ ID NO: 466 - protein, 108 aa, Artificial Sequence
  synthetic
DILMTQSPSSLSASVGDRVTITCRARQSINSYLNWYQQKPGKAPKLLIYVASSLQSGVPSRFSGSGSGTDFTLTINSLQPEDFAIYFCQQSYSTPITFGQGTKLEIKR

SEQ ID NO: 467 - DNA, 18 bp, Artificial Sequence
  synthetic
cagagcattaacagctat

SEQ ID NO: 468 - protein, 6 aa, Artificial Sequence
  synthetic
QSINSY

SEQ ID NO: 469 - DNA, 9 bp, Artificial Sequence
  synthetic
gttgcatcc

SEQ ID NO: 470 - protein, 3 aa, Artificial Sequence
  synthetic
VAS

SEQ ID NO: 471 - DNA, 27 bp, Artificial Sequence
  synthetic
caacagagttacagtaccccgatcacc

SEQ ID NO: 472 - protein, 9 aa, Artificial Sequence
  synthetic
QQSYSTPIT

SEQ ID NO: 473 - DNA, 354 bp, Artificial Sequence
  synthetic
gaggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcactaatatggtttgatggaagtaataaaaactatacagactccgtgaagggtcgattcaccatatccagagacaattccaagaacacactgtatctccaaatgagcagcctgagagccgaagacacggctgtatattattgtgcgacagaaatagcagctcgtccttttgaatattggggccagggaaccacggtcaccgtctcctca

SEQ ID NO: 474 - protein, 118 aa, Artificial Sequence
  synthetic
EVQLVESGGGVVQPGRSLRLSCAASGFTFSNYGMHWVRQAPGKGLEWVALIWFDGSNKNYTDSVKGRFTISRDNSKNTLYLQMSSLRAEDTAVYYCATEIAARPFEYWGQGTTVTVSS

SEQ ID NO: 475 - DNA, 24 bp, Artificial Sequence
  synthetic
ggattcaccttcagtaactatggc

SEQ ID NO: 476 - protein, 8 aa, Artificial Sequence
  synthetic
GFTFSNYG

SEQ ID NO: 477 - DNA, 24 bp, Artificial Sequence
  synthetic
atatggtttgatggaagtaataaa

SEQ ID NO: 478 - protein, 8 aa, Artificial Sequence
  synthetic
IWFDGSNK

SEQ ID NO: 479 - DNA, 33 bp, Artificial Sequence; identical to SEQ ID NO: 447
  synthetic

SEQ ID NO: 480 - protein, 11 aa, Artificial Sequence
  synthetic
ATEIAARPFEY

SEQ ID NO: 481 - DNA, 339 bp, Artificial Sequence
  synthetic
gacatcgtgatgacccagtctccactctccctgcccgtcacccctggagagccggcctccatctcctgcaagtctagtcagagcctccttcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaatccgtacacttttggccaggggaccaaggtggagatcaaacga

SEQ ID NO: 482 - protein, 113 aa, Artificial Sequence
  synthetic
DIVMTQSPLSLPVTPGEPASISCKSSQSLLHSNGYNYLDWYLQKPGQSPQLLIYLGSNRASGVPDRFSGSGSGTDFTLKISRVEAEDVGVYYCMQALQNPYTFGQGTKVEIKR

SEQ ID NO: 483 - DNA, 33 bp, Artificial Sequence
  synthetic
cagagcctccttcatagtaatggatacaactat

SEQ ID NO: 484 - protein, 11 aa, Artificial Sequence
  synthetic
QSLLHSNGYNY

SEQ ID NO: 485 - DNA, 9 bp, Artificial Sequence
  synthetic
ttgggttct

SEQ ID NO: 486 - protein, 3 aa, Artificial Sequence
  synthetic
LGS

SEQ ID NO: 487 - DNA, 27 bp, Artificial Sequence
  synthetic
atgcaagctctacaaaatccgtacact

SEQ ID NO: 488 - protein, 9 aa, Artificial Sequence
  synthetic
MQALQNPYT

SEQ ID NO: 489 - DNA, 354 bp, Artificial Sequence; identical to SEQ ID NO: 425
  synthetic

SEQ ID NO: 490 - protein, 118 aa, Artificial Sequence; identical to SEQ ID NO: 426
  synthetic

SEQ ID NO: 491 - DNA, 24 bp, Artificial Sequence
  synthetic
ggattcaccttcagtagctatggc

SEQ ID NO: 492 - protein, 8 aa, Artificial Sequence
  synthetic
GFTFSSYG

SEQ ID NO: 493 - DNA, 24 bp, Artificial Sequence
  synthetic
atatggtttgatggaagtaataaa

SEQ ID NO: 494 - protein, 8 aa, Artificial Sequence
  synthetic
IWFDGSNK

SEQ ID NO: 495 - DNA, 33 bp, Artificial Sequence; identical to SEQ ID NO: 335
  synthetic

SEQ ID NO: 496 - protein, 11 aa, Artificial Sequence
  synthetic
ATEIAARPFEY

SEQ ID NO: 497 - DNA, 324 bp, Artificial Sequence
  synthetic
gacatcctgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaaggtggagatcaaacga

SEQ ID NO: 498 - protein, 108 aa, Artificial Sequence
  synthetic
DILMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKR

SEQ ID NO: 499 - DNA, 18 bp, Artificial Sequence
  synthetic
cagagcattagcagctat

SEQ ID NO: 500 - protein, 6 aa, Artificial Sequence
  synthetic
QSISSY

SEQ ID NO: 501 - DNA, 9 bp, Artificial Sequence
  synthetic
gctgcatcc

SEQ ID NO: 502 - protein, 3 aa, Artificial Sequence
  synthetic
AAS

SEQ ID NO: 503 - DNA, 27 bp, Artificial Sequence
  synthetic
caacagagttacagtaccccgtacact

SEQ ID NO: 504 - protein, 9 aa, Artificial Sequence
  synthetic
QQSYSTPYT

SEQ ID NO: 505 - DNA, 354 bp, Artificial Sequence
  synthetic
gaggtgcagctggtggagtctgggggaggcgtggtccagcctgggaggtccctgagactctcctgtgcagcgtctgggttcaccttcagtaattatggcatgcactgggtccgccaggctccaggcaaggggctggagtgggtggcacttatatggtatgatggaagtaataaaaactatacagactccgtgaagggccgattcaccatctccagagacaattccaagaacacactgtatctgcaaatgaacagcctgagagccgaggacacggctgtgtatttctgtgcgagcgagatcgcagctcgtccttttgagtactggggccagggaaccatggtcaccgtctcctca

SEQ ID NO: 506 - protein, 118 aa, Artificial Sequence
  synthetic
EVQLVESGGGVVQPGRSLRLSCAASGFTFSNYGMHWVRQAPGKGLEWVALIWYDGSNKNYTDSVKGRFTISRDNSKNTLYLQMNSLRAEDTAVYFCASEIAARPFEYWGQGTMVTVSS

SEQ ID NO: 507 - DNA, 24 bp, Artificial Sequence
  synthetic
gggttcaccttcagtaattatggc

SEQ ID NO: 508 - protein, 8 aa, Artificial Sequence
  synthetic
GFTFSNYG

SEQ ID NO: 509 - DNA, 24 bp, Artificial Sequence
  synthetic
atatggtatgatggaagtaataaa

SEQ ID NO: 510 - protein, 8 aa, Artificial Sequence
  synthetic
IWYDGSNK

SEQ ID NO: 511 - DNA, 33 bp, Artificial Sequence
  synthetic
gcgagcgagatcgcagctcgtccttttgagtac

SEQ ID NO: 512 - protein, 11 aa, Artificial Sequence
  synthetic
ASEIAARPFEY

SEQ ID NO: 513 - DNA, 324 bp, Artificial Sequence
  synthetic
gacatcgtgatgacccagtctccttcctccctgtctgcatctttaggagacagagtcaccttcacttgccgggcaagtcagagcattcgcagccatttaaattggtatcagcagaaaccagggaaagcccctaagctcctgatctatactacatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaaggtggagatcaaacga

SEQ ID NO: 514 - protein, 108 aa, Artificial Sequence
  synthetic
DIVMTQSPSSLSASLGDRVTFTCRASQSIRSHLNWYQQKPGKAPKLLIYTTSSLQSGVPSRFSGSGSGTDFTLTISSLQPEDFATYYCQQSYSTPYTFGQGTKVEIKR

SEQ ID NO: 515 - DNA, 18 bp, Artificial Sequence
  synthetic
cagagcattcgcagccat

SEQ ID NO: 516 - protein, 6 aa, Artificial Sequence
  synthetic
QSIRSH

SEQ ID NO: 517 - DNA, 9 bp, Artificial Sequence
  synthetic
actacatcc

SEQ ID NO: 518 - protein, 3 aa, Artificial Sequence
  synthetic
TTS

SEQ ID NO: 519 - DNA, 27 bp, Artificial Sequence
  synthetic
caacagagttacagtaccccgtacact

SEQ ID NO: 520 - protein, 9 aa, Artificial Sequence
  synthetic
QQSYSTPYT

SEQ ID NO: 521 - DNA, 354 bp, Artificial Sequence
  synthetic
gaggtgcagctggtggagtctgggggaggcttggtacagcctggggggaccctgagactctcctgtgcagcctctggattcacctttagcacctatgccatgacctgggtccgccaggctccagggaaggggctggagtgggtctcaagtattagtagtagtggtgttagcacatactacgcagactccgtgaagggccggttcaccatttccagagacaattccaagaacacggtgtatctgcacatgaacagcctgagagccgaggacacggccctatattactgtgcgcaagggagtagctggtactactttgactactggggccagggaaccctggtcaccgtctcctca

SEQ ID NO: 522 - protein, 118 aa, Artificial Sequence
  synthetic
EVQLVESGGGLVQPGGTLRLSCAASGFTFSTYAMTWVRQAPGKGLEWVSSISSSGVSTYYADSVKGRFTISRDNSKNTVYLHMNSLRAEDTALYYCAQGSSWYYFDYWGQGTLVTVSS

SEQ ID NO: 523 - DNA, 24 bp, Artificial Sequence
  synthetic
ggattcacctttagcacctatgcc

SEQ ID NO: 524 - protein, 8 aa, Artificial Sequence
  synthetic
GFTFSTYA

SEQ ID NO: 525 - DNA, 24 bp, Artificial Sequence
  synthetic
attagtagtagtggtgttagcaca

SEQ ID NO: 526 - protein, 8 aa, Artificial Sequence
  synthetic
ISSSGVST

SEQ ID NO: 527 - DNA, 33 bp, Artificial Sequence
  synthetic
gcgcaagggagtagctggtactactttgactac

SEQ ID NO: 528 - protein, 11 aa, Artificial Sequence
  synthetic
AQGSSWYYFDY

SEQ ID NO: 529 - DNA, 324 bp, Artificial Sequence
  synthetic
gacatcgtgatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggccaagggaccaaggtggagatcaaacga

SEQ ID NO: 530 - protein, 108 aa, Artificial Sequence
  synthetic
DIVMTQSPSSLSASVGDRVTITCRASQGIRNDLGWYQQKPGKAPKRLIYAASSLQSGVPSRFSGSGSGTEFTLTISSLQPEDFATYYCLQHNSYPPTFGQGTKVEIKR

SEQ ID NO: 531 - DNA, 18 bp, Artificial Sequence
  synthetic
cagggcattagaaatgat

SEQ ID NO: 532 - protein, 6 aa, Artificial Sequence
  synthetic
QGIRND

SEQ ID NO: 533 - DNA, 9 bp, Artificial Sequence
  synthetic
gctgcatcc

SEQ ID NO: 534 - protein, 3 aa, Artificial Sequence
  synthetic
AAS

SEQ ID NO: 535 - DNA, 27 bp, Artificial Sequence
  synthetic
ctacagcataatagttaccctccgacg

SEQ ID NO: 536 - protein, 9 aa, Artificial Sequence
  synthetic
LQHNSYPPT

SEQ ID NO: 537 - DNA, 354 bp, Artificial Sequence
  synthetic
gaggtgcagctggtggagtctgggggaggcgtggtccagcctgggaggtccctgagactctcctgtgcagcgtctggattcaccttcagtagctatggcatgcactgggtccgccaggcgccaggcaaggggctggagtgggtggcacttatatggtatgatggaagtaataaaaactatacagactccgtgaagggtcgattcaccatctccagagacaattccaagaacacgctgtatctgcaaatgagcagcctgagagccgaggacacggctgtgtattattgtgcgacagagatagcagctcgtccttttgagtactggggccagggaaccctggtcaccgtctcctca

SEQ ID NO: 538 - protein, 118 aa, Artificial Sequence
  synthetic
EVQLVESGGGVVQPGRSLRLSCAASGFTFSSYGMHWVRQAPGKGLEWVALIWYDGSNKNYTDSVKGRFTISRDNSKNTLYLQMSSLRAEDTAVYYCATEIAARPFEYWGQGTLVTVSS

SEQ ID NO: 539 - DNA, 24 bp, Artificial Sequence
  synthetic
ggattcaccttcagtagctatggc

SEQ ID NO: 540 - protein, 8 aa, Artificial Sequence
  synthetic
GFTFSSYG

SEQ ID NO: 541 - DNA, 24 bp, Artificial Sequence
  synthetic
atatggtatgatggaagtaataaa

SEQ ID NO: 542 - protein, 8 aa, Artificial Sequence
  synthetic
IWYDGSNK

SEQ ID NO: 543 - DNA, 33 bp, Artificial Sequence; identical to SEQ ID NO: 335
  synthetic

SEQ ID NO: 544 - protein, 11 aa, Artificial Sequence
  synthetic
ATEIAARPFEY

SEQ ID NO: 545 - DNA, 324 bp, Artificial Sequence
  synthetic
gacatcctgatgacccagtctccatcctccctgtctgcatctgtaggagacagagtcaccatcacttgccgggcaagtcagagtattaagatctatttaaattggtatcagcagaaaccagggaaagcccctaaggtcctgatctatggtgcatccagtttacaaagtggggtcccatcaaggttcagtggcagtggatctgggacagatttcactctcaccatcagcagtcttcaacctgaagattttgcaacttacttctgtcaacagagttacagtaccccattcactttcggccctgggaccaaggtggagatcaaacga

SEQ ID NO: 546 - protein, 108 aa, Artificial Sequence
  synthetic
DILMTQSPSSLSASVGDRVTITCRASQSIKIYLNWYQQKPGKAPKVLIYGASSLQSGVPSRFSGSGSGTDFTLTISSLQPEDFATYFCQQSYSTPFTFGPGTKVEIKR

SEQ ID NO: 547 - DNA, 18 bp, Artificial Sequence
  synthetic
cagagtattaagatctat

SEQ ID NO: 548 - protein, 6 aa, Artificial Sequence
  synthetic
QSIKIY

SEQ ID NO: 549 - DNA, 9 bp, Artificial Sequence
  synthetic
ggtgcatcc

SEQ ID NO: 550 - protein, 3 aa, Artificial Sequence
  synthetic
GAS

SEQ ID NO: 551 - DNA, 27 bp, Artificial Sequence
  synthetic
caacagagttacagtaccccattcact

SEQ ID NO: 552 - protein, 9 aa, Artificial Sequence
  synthetic
QQSYSTPFT

SEQ ID NO: 553 - DNA, 354 bp, Artificial Sequence
  synthetic
gaggtgcagctggtggagtctgggggaggcgtggtccagcctgggaggtccctgagactctcctgtgcagcgtctggattcaccttcagtaattatggcatgcactgggtccgccaggctccaggcaaggggctggagtgggtggcacttatatggtatgatggaagtaataaaaactatacagactccgtgaagggccgattcaccatctccagagacaattccaagaacacactgtatctgcaaatgaacagcctgagagccgaggacacggctgtgtatttctgtgcgagcgagatcgcagctcgtccttttgagtactggggccagggaaccatggtcaccgtctcctca

SEQ ID NO: 554 - protein, 118 aa, Artificial Sequence; identical to SEQ ID NO: 506
  synthetic

SEQ ID NO: 555 - DNA, 24 bp, Artificial Sequence
  synthetic
ggattcaccttcagtaattatggc

SEQ ID NO: 556 - protein, 8 aa, Artificial Sequence
  synthetic
GFTFSNYG

SEQ ID NO: 557 - DNA, 24 bp, Artificial Sequence
  synthetic
atatggtatgatggaagtaataaa

SEQ ID NO: 558 - protein, 8 aa, Artificial Sequence
  synthetic
IWYDGSNK

SEQ ID NO: 559 - DNA, 33 bp, Artificial Sequence; identical to SEQ ID NO: 511
  synthetic

SEQ ID NO: 560 - protein, 11 aa, Artificial Sequence
  synthetic
ASEIAARPFEY

SEQ ID NO: 561 - DNA, 324 bp, Artificial Sequence
  synthetic
gacatcctgatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgctcactttcggcggagggaccaaggtggagatcaaacga

SEQ ID NO: 562 - protein, 108 aa, Artificial Sequence
  synthetic
DILMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIKR

SEQ ID NO: 563 - DNA, 18 bp, Artificial Sequence
  synthetic
caggacattagcaactat

SEQ ID NO: 564 - protein, 6 aa, Artificial Sequence
  synthetic
QDISNY

SEQ ID NO: 565 - DNA, 9 bp, Artificial Sequence
  synthetic
gatgcatcc

SEQ ID NO: 566 - protein, 3 aa, Artificial Sequence
  synthetic
DAS

SEQ ID NO: 567 - DNA, 27 bp, Artificial Sequence
  synthetic
caacagtatgataatctcccgctcact

SEQ ID NO: 568 - protein, 9 aa, Artificial Sequence
  synthetic
QQYDNLPLT

SEQ ID NO: 569 - DNA, 354 bp, Artificial Sequence
  synthetic
gaggtgcagctggtggagtctgggggaggcgaggtccagcctggggggtccctgagactctcctgtgcagcgtctggattcaccttcagtaactatggcatgcactgggtccgccaggctccaggcaaggggctggagtgggtggcactaatatggtatgatggaagtaataaaaactatacagactccgtgaagggtcgattcaccatatccagagacaattccaagaacactctgtatctccaaatgagcagcctgagagccgaagacacggctgtatattattgtgcgacagaaatagcagctcgtccttttgaatattggggccagggaaccacggtcaccgtctcctca

SEQ ID NO: 570 - protein, 118 aa, Artificial Sequence
  synthetic
EVQLVESGGGEVQPGGSLRLSCAASGFTFSNYGMHWVRQAPGKGLEWVALIWYDGSNKNYTDSVKGRFTISRDNSKNTLYLQMSSLRAEDTAVYYCATEIAARPFEYWGQGTTVTVSS

SEQ ID NO: 571 - DNA, 24 bp, Artificial Sequence
  synthetic
ggattcaccttcagtaactatggc

SEQ ID NO: 572 - protein, 8 aa, Artificial Sequence
  synthetic
GFTFSNYG

SEQ ID NO: 573 - DNA, 24 bp, Artificial Sequence
  synthetic
atatggtatgatggaagtaataaa

SEQ ID NO: 574 - protein, 8 aa, Artificial Sequence
  synthetic
IWYDGSNK

SEQ ID NO: 575 - DNA, 33 bp, Artificial Sequence; identical to SEQ ID NO: 447
  synthetic

SEQ ID NO: 576 - protein, 11 aa, Artificial Sequence
  synthetic
ATEIAARPFEY

SEQ ID NO: 577 - DNA, 324 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaaggtggaaatcaaacga

SEQ ID NO: 578 - protein, 108 aa, Artificial Sequence
  synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKVEIKR

SEQ ID NO: 579 - DNA, 18 bp, Artificial Sequence
  synthetic
cagggcattagaaatgat

SEQ ID NO: 580 - protein, 6 aa, Artificial Sequence
  synthetic
QGIRND

SEQ ID NO: 581 - DNA, 9 bp, Artificial Sequence
  synthetic
gctgcatcc

SEQ ID NO: 582 - protein, 3 aa, Artificial Sequence
  synthetic
AAS

SEQ ID NO: 583 - DNA, 27 bp, Artificial Sequence
  synthetic
ctacagcataatagttacccgtacact

SEQ ID NO: 584 - protein, 9 aa, Artificial Sequence
  synthetic
LQHNSYPYT

SEQ ID NO: 585 - DNA, 372 bp, Artificial Sequence
  synthetic
gaggtgcagctggtggagtctgggggaggcttggtccagcctggggggtccctgagactctcctgtgcagcctctggattcacctttagaagctatttgatgaactgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacaccctgagagccgaggacacggctgtgtattactgtgcgagagcccattacgatttttggagtgcttgggactacggtatggacgtctggggccaagggaccacggtcaccgtctcctca

SEQ ID NO: 586 - protein, 124 aa, Artificial Sequence
  synthetic
EVQLVESGGGLVQPGGSLRLSCAASGFTFRSYLMNWVRQAPGKGLEWVANIKQDGSEKYYVDSVKGRFTISRDNAKNSLYLQMNTLRAEDTAVYYCARAHYDFWSAWDYGMDVWGQGTTVTVSS

SEQ ID NO: 587 - DNA, 24 bp, Artificial Sequence
  synthetic
ggattcacctttagaagctatttg

SEQ ID NO: 588 - protein, 8 aa, Artificial Sequence
  synthetic
GFTFRSYL

SEQ ID NO: 589 - DNA, 24 bp, Artificial Sequence
  synthetic
ataaagcaagatggaagtgagaaa

SEQ ID NO: 590 - protein, 8 aa, Artificial Sequence
  synthetic
IKQDGSEK

SEQ ID NO: 591 - DNA, 51 bp, Artificial Sequence
  synthetic
gcgagagcccattacgatttttggagtgcttgggactacggtatggacgtc

SEQ ID NO: 592 - protein, 17 aa, Artificial Sequence
  synthetic
ARAHYDFWSAWDYGMDV

SEQ ID NO: 593 - DNA, 324 bp, Artificial Sequence
  synthetic
gacatcctgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggccgagggaccaaggtggagatcaaacga

SEQ ID NO: 594 - protein, 108 aa, Artificial Sequence
  synthetic
DILMTQSPSSLSASVGDRVTITCRASQSISSYLNWYQQKPGKAPKLLIYAASSLQSGVPSRFSGSGSGTDFTLTISSLQPEDFATYYCQQSYSTPLTFGRGTKVEIKR

SEQ ID NO: 595 - DNA, 18 bp, Artificial Sequence
  synthetic
cagagcattagcagctat

SEQ ID NO: 596 - protein, 6 aa, Artificial Sequence
  synthetic
QSISSY

SEQ ID NO: 597 - DNA, 9 bp, Artificial Sequence
  synthetic
gctgcatcc

SEQ ID NO: 598 - protein, 3 aa, Artificial Sequence
  synthetic
AAS

SEQ ID NO: 599 - DNA, 27 bp, Artificial Sequence
  synthetic
caacagagttacagtaccccgctcact

SEQ ID NO: 600 - protein, 9 aa, Artificial Sequence
  synthetic
QQSYSTPLT

SEQ ID NO: 601 - DNA, 384 bp, Artificial Sequence; identical to SEQ ID NO: 457
  synthetic

SEQ ID NO: 602 - protein, 128 aa, Artificial Sequence; identical to SEQ ID NO: 458
  synthetic

SEQ ID NO: 603 - DNA, 24 bp, Artificial Sequence
  synthetic
ggattcacctttgctgattatgga

SEQ ID NO: 604 - protein, 8 aa, Artificial Sequence
  synthetic
GFTFADYG

SEQ ID NO: 605 - DNA, 24 bp, Artificial Sequence
  synthetic
attaattataagggtgatagtaca

SEQ ID NO: 606 - protein, 8 aa, Artificial Sequence
  synthetic
INYKGDST

SEQ ID NO: 607 - DNA, 63 bp, Artificial Sequence; identical to SEQ ID NO: 463
  synthetic

SEQ ID NO: 608 - protein, 21 aa, Artificial Sequence
  synthetic
AREIYCINGVCYTDYYYGMDV

SEQ ID NO: 609 - DNA, 327 bp, Artificial Sequence
  synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccccatattcactttcggccctgggaccaaggtggagatcaaacga

SEQ ID NO: 610 - protein, 109 aa, Artificial Sequence
  synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPIFTFGPGTKVEIKR

SEQ ID NO: 611 - DNA, 18 bp, Artificial Sequence
  synthetic
caggacattagcaactat

SEQ ID NO: 612 - protein, 6 aa, Artificial Sequence
  synthetic
QDISNY

SEQ ID NO: 613 - DNA, 9 bp, Artificial Sequence
  synthetic
gatgcatcc

SEQ ID NO: 614 - protein, 3 aa, Artificial Sequence
  synthetic
DAS

SEQ ID NO: 615 - DNA, 30 bp, Artificial Sequence
  synthetic
caacagtatgataatctccccatattcact

SEQ ID NO: 616 - protein, 10 aa, Artificial Sequence
  synthetic
QQYDNLPIFT

SEQ ID NO: 617 - DNA, 366 bp, Artificial Sequence
  synthetic
caggtgcagctggtgcagtggggcgcaggactgttgaagccttcggagaccctgtccctcacctgcgctgtctatggtgggtccttcagtggtttctactggacctggatccgccagcccccagggaaggggctggagtggattggggaaatcagtcatagtggaaacaccgactacatcccgtccctcaagagtcgagtcaccatatcattagacacgtccaagaaccagttctccctgaagctgaactctgtgaccgccgcggacacggctttttattactgtgcgagaggtcctttttacgatattttgactggttatccctttgactactggggccagggaaccacggtcaccgtctcctca

SEQ ID NO: 618 - protein, 122 aa, Artificial Sequence
  synthetic
QVQLVQWGAGLLKPSETLSLTCAVYGGSFSGFYWTWIRQPPGKGLEWIGEISHSGNTDYIPSLKSRVTISLDTSKNQFSLKLNSVTAADTAFYYCARGPFYDILTGYPFDYWGQGTTVTVSS

SEQ ID NO: 619 - DNA, 24 bp, Artificial Sequence
  synthetic
ggtgggtccttcagtggtttctac

SEQ ID NO: 620 - protein, 8 aa, Artificial Sequence
  synthetic
GGSFSGFY

SEQ ID NO: 621 - DNA, 21 bp, Artificial Sequence
  synthetic
atcagtcatagtggaaacacc

SEQ ID NO: 622 - protein, 7 aa, Artificial Sequence
  synthetic
ISHSGNT

SEQ ID NO: 623 - DNA, 48 bp, Artificial Sequence
  synthetic
gcgagaggtcctttttacgatattttgactggttatccctttgactac

SEQ ID NO: 624 - protein, 16 aa, Artificial Sequence
  synthetic
ARGPFYDILTGYPFDY

SEQ ID NO: 625 - DNA, 324 bp, Artificial Sequence
  synthetic
gacatcgtgatgacccagtctccagccattctgtctgtgtctccaggggaaagagccaccctctcctgcagggccagtcagagtgttagcagcaacttagcctggtaccagcagaaacctggccaggctcccaggctcttcatctatggtgcatccaccagggccactggtatcccagccagattcagtggcagtgggtctgggacagagttcactctcaccatcagcagcctgcagtctgaagattttgcagtttattactgtcagcagtataataactggcctctcactttcggcggagggaccaaggtggagatcaaacga

SEQ ID NO: 626 - protein, 108 aa, Artificial Sequence
  synthetic
DIVMTQSPAILSVSPGERATLSCRASQSVSSNLAWYQQKPGQAPRLFIYGASTRATGIPARFSGSGSGTEFTLTISSLQSEDFAVYYCQQYNNWPLTFGGGTKVEIKR

SEQ ID NO: 627 - DNA, 18 bp, Artificial Sequence
  synthetic
cagagtgttagcagcaac

SEQ ID NO: 628 - protein, 6 aa, Artificial Sequence
  synthetic
QSVSSN

SEQ ID NO: 629 - DNA, 9 bp, Artificial Sequence
  synthetic
ggtgcatcc

SEQ ID NO: 630 - protein, 3 aa, Artificial Sequence
  synthetic
GAS

SEQ ID NO: 631 - DNA, 27 bp, Artificial Sequence
  synthetic
cagcagtataataactggcctctcact

SEQ ID NO: 632 - protein, 9 aa, Artificial Sequence
  synthetic
QQYNNWPLT

SEQ ID NO: 633 - DNA, 360 bp, Artificial Sequence
  synthetic
caggtgcagctggtggagtctgggggagacttggtccagcctggggggtccctgagactctcctgtgcagcctctggattcacctttactagctattggatgaactgggtccgccaggctccagggaaggggctggagtgggtggccaatataaaacaagatggaactgagaactactatgtggactctgtgaagggccgattcaccatttccagagacaatgccaagaactcactgtatctgcaaatgagcagcctgagagccgaggacacggctgtgtattactgtgcgagagatcaccccgtgggagctcctttctttgactactggggccagggaaccctggtcaccgtctcctca

SEQ ID NO: 634 - protein, 120 aa, Artificial Sequence
  synthetic
QVQLVESGGDLVQPGGSLRLSCAASGFTFTSYWMNWVRQAPGKGLEWVANIKQDGTENYYVDSVKGRFTISRDNAKNSLYLQMSSLRAEDTAVYYCARDHPVGAPFFDYWGQGTLVTVSS

SEQ ID NO: 635 - DNA, 24 bp, Artificial Sequence
  synthetic
ggattcacctttactagctattgg

SEQ ID NO: 636 - protein, 8 aa, Artificial Sequence
  synthetic
GFTFTSYW

SEQ ID NO: 637 - DNA, 24 bp, Artificial Sequence
  synthetic
ataaaacaagatggaactgagaac

SEQ ID NO: 638 - protein, 8 aa, Artificial Sequence
  synthetic
IKQDGTEN

SEQ ID NO: 639 - DNA, 39 bp, Artificial Sequence
  synthetic
gcgagagatcaccccgtgggagctcctttctttgactac

SEQ ID NO: 640 - protein, 13 aa, Artificial Sequence
  synthetic
ARDHPVGAPFFDY

SEQ ID NO: 641 - DNA, 324 bp, Artificial Sequence
  synthetic
gacatcctgatgacccagtctccatcctccctgtctgcatctgtaggagacagagtcaccatcacttgccgggcaagtcagagcattagctactatttaaattggtatcaacagaaaccagggaaagcccctaagctcctgatctatagtgaatccagtttgcaaagtggggtcccatcaaggttcagtggcagtggatctgggacagatttcactctcaccatcagcagtctgcaacctgaagattttgcaacttactactgtcaacagagttacactaccccgtacacttttggccaggggaccaaggtggagatcaaacga

SEQ ID NO: 642 - protein, 108 aa, Artificial Sequence
  synthetic
DILMTQSPSSLSASVGDRVTITCRASQSISYYLNWYQQKPGKAPKLLIYSESSLQSGVPSRFSGSGSGTDFTLTISSLQPEDFATYYCQQSYTTPYTFGQGTKVEIKR

SEQ ID NO: 643 - DNA, 18 bp, Artificial Sequence
  synthetic
cagagcattagctactat

SEQ ID NO: 644 - protein, 6 aa, Artificial Sequence
  synthetic
QSISYY

SEQ ID NO: 645 - DNA, 9 bp, Artificial Sequence
  synthetic
agtgaatcc

SEQ ID NO: 646 - protein, 3 aa, Artificial Sequence
  synthetic
SES

SEQ ID NO: 647 - DNA, 27 bp, Artificial Sequence
  synthetic
caacagagttacactaccccgtacact

SEQ ID NO: 648 - protein, 9 aa, Artificial Sequence
  synthetic
QQSYTTPYT

SEQ ID NO: 649 - DNA, 366 bp, Artificial Sequence
  synthetic
caggtgcagctggtgcagtggggcgcaggactgttgaagccttcggagaccctgtccctcacctgcgctgtctatggtgggtccttcaatggtttctactggacctggatccgccagcccccagggaaggggctggagtggattggggaaatcagtcatagtggaaacaccgactacatcccgtccctcaagagtcgagtcaccatatcaatagacacgtccaagagccagttcttcctgaagctgaactctgtgaccgccgcggacacggctttttattactgtgcgaggggtcccttttacgatattttgactggctacccctttgactactggggccagggaaccacggtcaccgtctcctca

SEQ ID NO: 650 - protein, 122 aa, Artificial Sequence
  synthetic
QVQLVQWGAGLLKPSETLSLTCAVYGGSFNGFYWTWIRQPPGKGLEWIGEISHSGNTDYIPSLKSRVTISIDTSKSQFFLKLNSVTAADTAFYYCARGPFYDILTGYPFDYWGQGTTVTVSS

SEQ ID NO: 651 - DNA, 24 bp, Artificial Sequence
  synthetic
ggtgggtccttcaatggtttctac

SEQ ID NO: 652 - protein, 8 aa, Artificial Sequence
  synthetic
GGSFNGFY

SEQ ID NO: 653 - DNA, 21 bp, Artificial Sequence
  synthetic
atcagtcatagtggaaacacc

SEQ ID NO: 654 - protein, 7 aa, Artificial Sequence
  synthetic
ISHSGNT

SEQ ID NO: 655 - DNA, 48 bp, Artificial Sequence
  synthetic
gcgaggggtcccttttacgatattttgactggctacccctttgactac

SEQ ID NO: 656 - protein, 16 aa, Artificial Sequence
  synthetic
ARGPFYDILTGYPFDY

SEQ ID NO: 657 - DNA, 324 bp, Artificial Sequence
  synthetic
gacatcgtgatgacccagtctccagccattctgtctgtgtctccaggggaaagagccaccctctcctgcagggccagtcagagtattgacagccacttagcctggtacctgcagaaacctggccaggctcccaggctcttcatctatggtgcatcctccagggccactggtatcccagtcagattcagtggcagtgggtctgggacagagttcactctcaccatcagcagcctgcagtctgaagattttgcagtttattactgtcagcagtataatagttggcctctcactttcggcggagggaccaagctggagatcaaacga

SEQ ID NO: 658 - protein, 108 aa, Artificial Sequence
  synthetic
DIVMTQSPAILSVSPGERATLSCRASQSIDSHLAWYLQKPGQAPRLFIYGASSRATGIPVRFSGSGSGTEFTLTISSLQSEDFAVYYCQQYNSWPLTFGGGTKLEIKR

SEQ ID NO: 659 - DNA, 18 bp, Artificial Sequence
  synthetic
cagagtattgacagccac

SEQ ID NO: 660 - protein, 6 aa, Artificial Sequence
  synthetic
QSIDSH

SEQ ID NO: 661 - DNA, 9 bp, Artificial Sequence
  synthetic
ggtgcatcc

SEQ ID NO: 662 - protein, 3 aa, Artificial Sequence
  synthetic
GAS

SEQ ID NO: 663 - DNA, 27 bp, Artificial Sequence
  synthetic
cagcagtataatagttggcctctcact

SEQ ID NO: 664 - protein, 9 aa, Artificial Sequence
  synthetic
QQYNSWPLT

SEQ ID NO: 665 - DNA, 360 bp, Artificial Sequence
  synthetic
gaggtgcagctggtggagtctgggggaggcttggtccagcctggggggtccctgagactctcctgtgcagcctctggattcatgtttagtggttattggatgaactgggtccgtcaggctccagggaaggggctggagtgggtggccaacataaagcaagatggaggtgagaaatactatgtggactctgtgaagggccgattcaccatctccagagacaacgccaagaactcactgtatctgcaaatgaacagcctgagagccgaggacatggctgtgtattactgtgcgagagatcacccagtgggagctcctttctttgactactggggccagggaaccctggtcaccgtctcctca

SEQ ID NO: 666 - protein, 120 aa, Artificial Sequence
  synthetic
EVQLVESGGGLVQPGGSLRLSCAASGFMFSGYWMNWVRQAPGKGLEWVANIKQDGGEKYYVDSVKGRFTISRDNAKNSLYLQMNSLRAEDMAVYYCARDHPVGAPFFDYWGQGTLVTVSS

SEQ ID NO: 667 - DNA, 24 bp, Artificial Sequence
  synthetic
ggattcatgtttagtggttattgg

SEQ ID NO: 668 - protein, 8 aa, Artificial Sequence
  synthetic
GFMFSGYW

SEQ ID NO: 669 - DNA, 24 bp, Artificial Sequence
  synthetic
ataaagcaagatggaggtgagaaa

SEQ ID NO: 670 - protein, 8 aa, Artificial Sequence
  synthetic
IKQDGGEK

SEQ ID NO: 671 - DNA, 39 bp, Artificial Sequence
  synthetic
gcgagagatcacccagtgggagctcctttctttgactac

SEQ ID NO: 672 - protein, 13 aa, Artificial Sequence
  synthetic
ARDHPVGAPFFDY

SEQ ID NO: 673 - DNA, 324 bp, Artificial Sequence
  synthetic
gacatcctgatgacccagtctccatcctccctgtctgcatctgtaggagacagagtcaccatcacttgccgggcaagtcagagcattagctactatttaaattggtatcagcagaaaccagggaaagcccctaagctcctgatctgtgctgcatccagtttgcaaagtggggtcccatcaaggttcagtggcactggatctgggacagatttcactctcaccatcagcagtctgcaacctgaagattttgcaacttacttctgtcaacagagttacagtaccccgtacacttttggccaggggaccaaggtggagatcaaacga

SEQ ID NO: 674 - protein, 108 aa, Artificial Sequence
  synthetic
DILMTQSPSSLSASVGDRVTITCRASQSISYYLNWYQQKPGKAPKLLICAASSLQSGVPSRFSGTGSGTDFTLTISSLQPEDFATYFCQQSYSTPYTFGQGTKVEIKR

SEQ ID NO: 675 - DNA, 18 bp, Artificial Sequence
  synthetic
cagagcattagctactat

SEQ ID NO: 676 - protein, 6 aa, Artificial Sequence
  synthetic
QSISYY

SEQ ID NO: 677 - DNA, 9 bp, Artificial Sequence
  synthetic
gctgcatcc

SEQ ID NO: 678 - protein, 3 aa, Artificial Sequence
  synthetic
AAS

SEQ ID NO: 679 - DNA, 27 bp, Artificial Sequence
  synthetic
caacagagttacagtaccccgtacact

SEQ ID NO: 680 - protein, 9 aa, Artificial Sequence
  synthetic
QQSYSTPYT

SEQ ID NO: 681 - DNA, 366 bp, Artificial Sequence
  synthetic
caggtgcagctggtgcagtggggcgcaggactgttgaagccttcggagaccctgtccctcacctgcgctgtctatggtgggtccttcagtggtttctactggacctggatccgccagcccccagggaaggggctggagtggattggggaaatcagtcatagtggaaacaccgactacatcccgtccctcaagagtcgagtcaccatatcattagacacgtccaagaaccagttctccctgaagctgaactctgtgaccgccgcggacacggctttttattactgtgcgagaggtcctttttacgatattttgactggttacccctttgactactggggccagggaaccctggtcaccgtctcctca

SEQ ID NO: 682 - protein, 122 aa, Artificial Sequence
  synthetic
QVQLVQWGAGLLKPSETLSLTCAVYGGSFSGFYWTWIRQPPGKGLEWIGEISHSGNTDYIPSLKSRVTISLDTSKNQFSLKLNSVTAADTAFYYCARGPFYDILTGYPFDYWGQGTLVTVSS

SEQ ID NO: 683 - DNA, 24 bp, Artificial Sequence
  synthetic
ggtgggtccttcagtggtttctac

SEQ ID NO: 684 - protein, 8 aa, Artificial Sequence
  synthetic
GGSFSGFY

SEQ ID NO: 685 - DNA, 21 bp, Artificial Sequence
  synthetic
atcagtcatagtggaaacacc

SEQ ID NO: 686 - protein, 7 aa, Artificial Sequence
  synthetic
ISHSGNT

SEQ ID NO: 687 - DNA, 48 bp, Artificial Sequence
  synthetic
gcgagaggtcctttttacgatattttgactggttacccctttgactac

SEQ ID NO: 688 - protein, 16 aa, Artificial Sequence
  synthetic
ARGPFYDILTGYPFDY

SEQ ID NO: 689 - DNA, 324 bp, Artificial Sequence
  synthetic
gacatcgtgatgacccagtctccagccattctgtctgtgtctccaggggaaagagccaccctctcctgcagggccagtcagagtgttagcagcaacttagcctggtaccagcagaaacctggccaggctcccaggctcttcatctatggtgcatccaccagggccactggtatcccagccagattcagtggcagtgggtctgggacagagttcactctcaccatcagcagcctgcagtctgaagattttgcagtttattactgtcagcagtatgatacctggcctctcactttcggcggagggaccaaggtggagatcaaacga

SEQ ID NO: 690 - protein, 108 aa, Artificial Sequence
  synthetic
DIVMTQSPAILSVSPGERATLSCRASQSVSSNLAWYQQKPGQAPRLFIYGASTRATGIPARFSGSGSGTEFTLTISSLQSEDFAVYYCQQYDTWPLTFGGGTKVEIKR

SEQ ID NO: 691 - DNA, 18 bp, Artificial Sequence
  synthetic
cagagtgttagcagcaac

SEQ ID NO: 692 - protein, 6 aa, Artificial Sequence
  synthetic
QSVSSN

SEQ ID NO: 693 - DNA, 9 bp, Artificial Sequence
  synthetic
ggtgcatcc

SEQ ID NO: 694 - protein, 3 aa, Artificial Sequence
  synthetic
GAS

SEQ ID NO: 695 - DNA, 27 bp, Artificial Sequence
  synthetic
cagcagtatgatacctggcctctcact

SEQ ID NO: 696 - protein, 9 aa, Artificial Sequence
  synthetic
QQYDTWPLT

SEQ ID NO: 697 - DNA, 360 bp, Artificial Sequence
  synthetic
gaggtgcagctggtggagtctgggggaggcttggtccagccgggggggtccctgagactctcctgtgcagcctctggattcatctttagtagctattggatgaactgggtccgccagactccagggaaggggctggagtgggtggccaatataaaacaagatggaactgagaaatattatgtggactctgtgaagggccgattcaccatctccagagacaatgccaagaaatcactatatctgcaaatgagcagcctgagagccgaggacacggctgtgtatttctgtgcgagagatcacccagtgggagctcctttctttgactactggggccagggaaccatggtcaccgtctcctca

SEQ ID NO: 698 - protein, 120 aa, Artificial Sequence
  synthetic
EVQLVESGGGLVQPGGSLRLSCAASGFIFSSYWMNWVRQTPGKGLEWVANIKQDGTEKYYVDSVKGRFTISRDNAKKSLYLQMSSLRAEDTAVYFCARDHPVGAPFFDYWGQGTMVTVSS

SEQ ID NO: 699 - DNA, 24 bp, Artificial Sequence
  synthetic
ggattcatctttagtagctattgg

SEQ ID NO: 700 - protein, 8 aa, Artificial Sequence
  synthetic
GFIFSSYW

SEQ ID NO: 701 - DNA, 24 bp, Artificial Sequence
  synthetic
ataaaacaagatggaactgagaaa

SEQ ID NO: 702 - protein, 8 aa, Artificial Sequence
  synthetic
IKQDGTEK

SEQ ID NO: 703 - DNA, 39 bp, Artificial Sequence; identical to SEQ ID NO: 671
  synthetic

SEQ ID NO: 704 - protein, 13 aa, Artificial Sequence
  synthetic
ARDHPVGAPFFDY

SEQ ID NO: 705 - DNA, 324 bp, Artificial Sequence
  synthetic
gacatcctgatgacccagtctccatcctccctgtctgcatctgtaggagacagagtcaccatcacttgccgggcaagtcagagcattagttactatttaaattggtatcagcagaaaccagggaaagcccctaacctcctaatctatagtacatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaaggtggagatcaaacga

SEQ ID NO: 706 - protein, 108 aa, Artificial Sequence
  synthetic
DILMTQSPSSLSASVGDRVTITCRASQSISYYLNWYQQKPGKAPNLLIYSTSSLQSGVPSRFSGSGSGTDFTLTISSLQPEDFATYYCQQSYSTPYTFGQGTKVEIKR

SEQ ID NO: 707 - DNA, 18 bp, Artificial Sequence
  synthetic
cagagcattagttactat

SEQ ID NO: 708 - protein, 6 aa, Artificial Sequence
  synthetic
QSISYY

SEQ ID NO: 709 - DNA, 9 bp, Artificial Sequence
  synthetic
agtacatcc

SEQ ID NO: 710 - protein, 3 aa, Artificial Sequence
  synthetic
STS

SEQ ID NO: 711 - DNA, 27 bp, Artificial Sequence
  synthetic
caacagagttacagtaccccgtacact

SEQ ID NO: 712 - protein, 9 aa, Artificial Sequence
  synthetic
QQSYSTPYT

SEQ ID NO: 713 - DNA, 360 bp, Artificial Sequence; identical to SEQ ID NO: 665
  synthetic

SEQ ID NO: 714 - protein, 120 aa, Artificial Sequence; identical to SEQ ID NO: 666
  synthetic

SEQ ID NO: 715 - DNA, 24 bp, Artificial Sequence
  synthetic
ggattcatgtttagtggttattgg

SEQ ID NO: 716 - protein, 8 aa, Artificial Sequence
  synthetic
GFMFSGYW

SEQ ID NO: 717 - DNA, 24 bp, Artificial Sequence
  synthetic
ataaagcaagatggaggtgagaaa

SEQ ID NO: 718 - protein, 8 aa, Artificial Sequence
  synthetic
IKQDGGEK

SEQ ID NO: 719 - DNA, 39 bp, Artificial Sequence; identical to SEQ ID NO: 671
  synthetic

SEQ ID NO: 720 - protein, 13 aa, Artificial Sequence
  synthetic
ARDHPVGAPFFDY

SEQ ID NO: 721 - DNA, 324 bp, Artificial Sequence; identical to SEQ ID NO: 673
  synthetic

SEQ ID NO: 722 - protein, 108 aa, Artificial Sequence; identical to SEQ ID NO: 674
  synthetic

SEQ ID NO: 723 - DNA, 18 bp, Artificial Sequence
  synthetic
cagagcattagctactat

SEQ ID NO: 724 - protein, 6 aa, Artificial Sequence
  synthetic
QSISYY

SEQ ID NO: 725 - DNA, 9 bp, Artificial Sequence
  synthetic
gctgcatcc

SEQ ID NO: 726 - protein, 3 aa, Artificial Sequence
  synthetic
AAS

SEQ ID NO: 727 - DNA, 27 bp, Artificial Sequence
  synthetic
caacagagttacagtaccccgtacact

SEQ ID NO: 728 - protein, 9 aa, Artificial Sequence
  synthetic
QQSYSTPYT

SEQ ID NO: 729 - DNA, 360 bp, Artificial Sequence
  synthetic
gaggtgcagctggtggagtctgggggaggcttggtccagccgggggggtccctgagactctcctgtgcagcctctggattcatctttagtagctattggatgaactgggtccgccaggctccagggaaggggctggagtgggtggccaatataaaacaagatggaactgagaaatattatgtggactctgtgaagggccgattcaccatctccagagacaatgccaagaaatcactatatctgcaaatgagcagcctgagagccgaggacacggctgtgtattactgtgcgagagatcacccagtgggagctcctttctttgactactggggccagggaaccatggtcaccgtctcctca

SEQ ID NO: 730 - protein, 120 aa, Artificial Sequence
  synthetic
EVQLVESGGGLVQPGGSLRLSCAASGFIFSSYWMNWVRQAPGKGLEWVANIKQDGTEKYYVDSVKGRFTISRDNAKKSLYLQMSSLRAEDTAVYYCARDHPVGAPFFDYWGQGTMVTVSS

SEQ ID NO: 731 - DNA, 24 bp, Artificial Sequence
  synthetic
ggattcatctttagtagctattgg

SEQ ID NO: 732 - protein, 8 aa, Artificial Sequence
  synthetic
GFIFSSYW

SEQ ID NO: 733 - DNA, 24 bp, Artificial Sequence
  synthetic
ataaaacaagatggaactgagaaa

SEQ ID NO: 734 - protein, 8 aa, Artificial Sequence
  synthetic
IKQDGTEK

SEQ ID NO: 735 - DNA, 39 bp, Artificial Sequence; identical to SEQ ID NO: 671
  synthetic

SEQ ID NO: 736 - protein, 13 aa, Artificial Sequence
  synthetic
ARDHPVGAPFFDY

SEQ ID NO: 737 - DNA, 324 bp, Artificial Sequence
  synthetic
gacatcctgatgacccagtctccatcctccctgtctgcatctgtaggagacagagtcaccatcacttgccgggcaagtcagagcattagttactatttaaattggtatcagcagaaaccagggaaagcccctaacctcctaatctatagtacatccagtttgcaaagtggggtcccatcaaggttcagtggcagtggatctgggacagatttcactctcagcatcagcagtctgcaacctgaagattttgcaacttactactgtcaacagagttacagtaccccgtacacttttggccaggggaccaaggtggagatcaaacga

SEQ ID NO: 738 - protein, 108 aa, Artificial Sequence
  synthetic
DILMTQSPSSLSASVGDRVTITCRASQSISYYLNWYQQKPGKAPNLLIYSTSSLQSGVPSRFSGSGSGTDFTLSISSLQPEDFATYYCQQSYSTPYTFGQGTKVEIKR

SEQ ID NO: 739 - DNA, 18 bp, Artificial Sequence
  synthetic
cagagcattagttactat

SEQ ID NO: 740 - protein, 6 aa, Artificial Sequence
  synthetic
QSISYY

SEQ ID NO: 741 - DNA, 9 bp, Artificial Sequence
  synthetic
agtacatcc

SEQ ID NO: 742 - protein, 3 aa, Artificial Sequence
  synthetic
STS

SEQ ID NO: 743 - DNA, 27 bp, Artificial Sequence
  synthetic
caacagagttacagtaccccgtacact

SEQ ID NO: 744 - protein, 9 aa, Artificial Sequence
  synthetic
QQSYSTPYT

SEQ ID NO: 745 - DNA, 360 bp, Artificial Sequence
  synthetic
gaggtgcagctggtggagtctgggggaggcttggtccagcctgggggatccctgaggctctcctgtgcagcctctggattcacctttagtggctattggatgaactgggtccgccaggctccagggaaggggctggagtgggtggccaatataaaacacgatggaagtgagaaatactctgtggactctgtgaagggccgattcaccatctccagagacaacgccaagaactcactgtatctgcaaatgaacagcctgagagccgaggacacggctgtgtattactgtgcgagagatcacccagtgggagctcctttctttgactactggggtcagggaatcctggtcaccgtctcctca

SEQ ID NO: 746 - protein, 120 aa, Artificial Sequence
  synthetic
EVQLVESGGGLVQPGGSLRLSCAASGFTFSGYWMNWVRQAPGKGLEWVANIKHDGSEKYSVDSVKGRFTISRDNAKNSLYLQMNSLRAEDTAVYYCARDHPVGAPFFDYWGQGILVTVSS

SEQ ID NO: 747 - DNA, 24 bp, Artificial Sequence
  synthetic
ggattcacctttagtggctattgg

SEQ ID NO: 748 - protein, 8 aa, Artificial Sequence
  synthetic
GFTFSGYW

SEQ ID NO: 749 - DNA, 24 bp, Artificial Sequence
  synthetic
ataaaacacgatggaagtgagaaa

SEQ ID NO: 750 - protein, 8 aa, Artificial Sequence
  synthetic
IKHDGSEK

SEQ ID NO: 751 - DNA, 39 bp, Artificial Sequence; identical to SEQ ID NO: 671
  synthetic

SEQ ID NO: 752 - protein, 13 aa, Artificial Sequence
  synthetic
ARDHPVGAPFFDY

SEQ ID NO: 753 - DNA, 324 bp, Artificial Sequence
  synthetic
gacatcctgatgacccagtctccatcctccctgtctgcatctgtaggagacagagtcaccatcacttgccgggcaagtcagagcattagttactatttaaactggtatcagcagaaaccagggaaagccccaaagctcctgatctatagttcttccagtttgcgaggtggaatcccatcaaggttcagtggcagtgattctgggacagatttcactctcaccatcagcagtctgcaacctgaagattttgcaacttactactgtcaacagagttacagtaccccgtacacttttggccaggggaccaaggtggagatcaaacga

SEQ ID NO: 754 - protein, 108 aa, Artificial Sequence
  synthetic
DILMTQSPSSLSASVGDRVTITCRASQSISYYLNWYQQKPGKAPKLLIYSSSSLRGGIPSRFSGSDSGTDFTLTISSLQPEDFATYYCQQSYSTPYTFGQGTKVEIKR

SEQ ID NO: 755 - DNA, 18 bp, Artificial Sequence
  synthetic
cagagcattagttactat

SEQ ID NO: 756 - protein, 6 aa, Artificial Sequence
  synthetic
QSISYY

SEQ ID NO: 757 - DNA, 9 bp, Artificial Sequence
  synthetic
agttcttcc

SEQ ID NO: 758 - protein, 3 aa, Artificial Sequence
  synthetic
SSS

SEQ ID NO: 759 - DNA, 27 bp, Artificial Sequence
  synthetic
caacagagttacagtaccccgtacact

SEQ ID NO: 760 - protein, 9 aa, Artificial Sequence
  synthetic
QQSYSTPYT

SEQ ID NO: 761 - DNA, 366 bp, Artificial Sequence
  synthetic
caggtgcagctggtggagtcgggcccaggactggtgaagccttcggagaccctgtccctcacctgcactgtctctggtggctccatcagtaattactactggagctggatccgacagcccccagggaagggactggagtggattgggtatatctattacagtgggaacaccaagtacaacccctccctcaagagtcgagtcaccatatcagtagacacgtccaagaaccagttctccctgaacctgacgtctgtgaccactgcggacacggccgtgtattactgtgcgagagatatagtggctgcgattaggcctcactggtacttcgatctctggggccgtggcaccacggtcaccgtctcctca

SEQ ID NO: 762 - protein, 122 aa, Artificial Sequence
  synthetic
QVQLVESGPGLVKPSETLSLTCTVSGGSISNYYWSWIRQPPGKGLEWIGYIYYSGNTKYNPSLKSRVTISVDTSKNQFSLNLTSVTTADTAVYYCARDIVAAIRPHWYFDLWGRGTTVTVSS

SEQ ID NO: 763 - DNA, 24 bp, Artificial Sequence
  synthetic
ggtggctccatcagtaattactac

SEQ ID NO: 764 - protein, 8 aa, Artificial Sequence
  synthetic
GGSISNYY

SEQ ID NO: 765 - DNA, 21 bp, Artificial Sequence
  synthetic
atctattacagtgggaacacc

SEQ ID NO: 766 - protein, 7 aa, Artificial Sequence
  synthetic
IYYSGNT

SEQ ID NO: 767 - DNA, 48 bp, Artificial Sequence
  synthetic
gcgagagatatagtggctgcgattaggcctcactggtacttcgatctc

SEQ ID NO: 768 - protein, 16 aa, Artificial Sequence
  synthetic
ARDIVAAIRPHWYFDL

SEQ ID NO: 769 - DNA, 324 bp, Artificial Sequence
  synthetic
gacatccagatgacccagtctccatcctccctgtctgcgtctgtaggagacagagtcaccatcacttgccgggcaagtcagaccattaacacctatttaaattggtatcagcagaatccagggaaagcccctaaggtcctgatctatgctacatccattttgctaagtggggtcccatccagattcagtggcagtggatctgggacagatttcactctcaccatcagcagtctgcaacctgaagattttacaacttacttctgtcaacagagttacagtatccctcccactttcggcggagggaccaaggtggagatcaaacga

SEQ ID NO: 770 - protein, 108 aa, Artificial Sequence
  synthetic
DIQMTQSPSSLSASVGDRVTITCRASQTINTYLNWYQQNPGKAPKVLIYATSILLSGVPSRFSGSGSGTDFTLTISSLQPEDFTTYFCQQSYSIPPTFGGGTKVEIKR

SEQ ID NO: 771 - DNA, 18 bp, Artificial Sequence
  synthetic
cagaccattaacacctat

SEQ ID NO: 772 - protein, 6 aa, Artificial Sequence
  synthetic
QTINTY

SEQ ID NO: 773 - DNA, 9 bp, Artificial Sequence
  synthetic
gctacatcc

SEQ ID NO: 774 - protein, 3 aa, Artificial Sequence
  synthetic
ATS

SEQ ID NO: 775 - DNA, 27 bp, Artificial Sequence
  synthetic
caacagagttacagtatccctcccact

SEQ ID NO: 776 - protein, 9 aa, Artificial Sequence
  synthetic
QQSYSIPPT

SEQ ID NO: 777 - DNA, 375 bp, Artificial Sequence
  synthetic
gaggtgcagctggtggagtctgggggagacttggtacagcctggcaggtccctgagactctcctgtgcagcctctggattcacctttggtgattatgccatgcactgggtccgacaacctccagggaagggcctggagtgggtctcaggtattagttggaatggtggtagcataggctatgcggactctgtgaagggccgattcaccatctccagagacaacgccaagaactccctgtatctgcaaatgaacagtctgagacctgaggacacggccttgtattactgtgcaaaagatgggggtatagcagcagatgccgactattactacggtatggacgtctggggccaagggaccacggtcaccgtctcctca

SEQ ID NO: 778 - protein, 125 aa, Artificial Sequence
  synthetic
EVQLVESGGDLVQPGRSLRLSCAASGFTFGDYAMHWVRQPPGKGLEWVSGISWNGGSIGYADSVKGRFTISRDNAKNSLYLQMNSLRPEDTALYYCAKDGGIAADADYYYGMDVWGQGTTVTVSS

SEQ ID NO: 779 - DNA, 24 bp, Artificial Sequence
  synthetic
ggattcacctttggtgattatgcc

SEQ ID NO: 780 - protein, 8 aa, Artificial Sequence
  synthetic
GFTFGDYA

SEQ ID NO: 781 - DNA, 24 bp, Artificial Sequence
  synthetic
attagttggaatggtggtagcata

SEQ ID NO: 782 - protein, 8 aa, Artificial Sequence
  synthetic
ISWNGGSI

SEQ ID NO: 783 - DNA, 54 bp, Artificial Sequence
  synthetic
gcaaaagatgggggtatagcagcagatgccgactattactacggtatggacgtc

SEQ ID NO: 784 - protein, 18 aa, Artificial Sequence
  synthetic
AKDGGIAADADYYYGMDV

SEQ ID NO: 785 - DNA, 324 bp, Artificial Sequence
  synthetic
gacatcctgatgacccagtctccatcctccctgtctgcatctgtaggagacagagtcaccatcacttgccgggcgagtcagggcattaccaattttttagcctggtatcagcagaaaccagggaaagttcctaagctcctgatctatgctgcatccactttgcaatcaggggtcccgtctcggttcagtggcagtggatctgggacagatttcactctcaccatcagcagccttcagcctgaagatgttgcgacttattactgtcaaacctataacagtgccccgctcactttcggcggagggaccaaggtggagatcaaacga

SEQ ID NO: 786 - protein, 108 aa, Artificial Sequence
  synthetic
DILMTQSPSSLSASVGDRVTITCRASQGITNFLAWYQQKPGKVPKLLIYAASTLQSGVPSRFSGSGSGTDFTLTISSLQPEDVATYYCQTYNSAPLTFGGGTKVEIKR

SEQ ID NO: 787 - DNA, 18 bp, Artificial Sequence
  synthetic
cagggcattaccaatttt

SEQ ID NO: 788 - protein, 6 aa, Artificial Sequence
  synthetic
QGITNF

SEQ ID NO: 789 - DNA, 9 bp, Artificial Sequence
  synthetic
gctgcatcc

SEQ ID NO: 790 - protein, 3 aa, Artificial Sequence
  synthetic
AAS

SEQ ID NO: 791 - DNA, 27 bp, Artificial Sequence
  synthetic
caaacctataacagtgccccgctcact

SEQ ID NO: 792 - protein, 9 aa, Artificial Sequence
  synthetic
QTYNSAPLT

SEQ ID NO: 793 - DNA, 360 bp, Artificial Sequence
  synthetic
gaggtgcagctggtggagtctgggggaggcttggtacagcctggggggtccctgagactctcctgtgcagcctctggattcacctttagcaactatgccatgagctgggtccgccaggctccagggaaggggctggagtgggtctcagctattagtggtagtggtggtctcacatactacgcagactccgtgaagggccggttcaccatctccagagacaattccaagaacacgctgtatctgcaaatgaacagcctgagagccgaggacacggccgtatattactgtgcgaacctcggtataactggaactaccccctttgactactggggccagggaaccacggtcaccgtctcctca

SEQ ID NO: 794 - protein, 120 aa, Artificial Sequence
  synthetic
EVQLVESGGGLVQPGGSLRLSCAASGFTFSNYAMSWVRQAPGKGLEWVSAISGSGGLTYYADSVKGRFTISRDNSKNTLYLQMNSLRAEDTAVYYCANLGITGTTPFDYWGQGTTVTVSS

SEQ ID NO: 795 - DNA, 24 bp, Artificial Sequence
  synthetic
ggattcacctttagcaactatgcc

SEQ ID NO: 796 - protein, 8 aa, Artificial Sequence
  synthetic
GFTFSNYA

SEQ ID NO: 797 - DNA, 24 bp, Artificial Sequence
  synthetic
attagtggtagtggtggtctcaca

SEQ ID NO: 798 - protein, 8 aa, Artificial Sequence
  synthetic
ISGSGGLT

SEQ ID NO: 799 - DNA, 39 bp, Artificial Sequence
  synthetic
gcgaacctcggtataactggaactaccccctttgactac

SEQ ID NO: 800 - protein, 13 aa, Artificial Sequence
  synthetic
ANLGITGTTPFDY

SEQ ID NO: 801 - DNA, 324 bp, Artificial Sequence
  synthetic
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtgaatctgggacagatttcactctcaccatcagcagtctgcaacctgaagattttgcaacttactactgtcaacagagttacagtacccctcccactttcggcggagggaccaaggtggagatcaaacga

SEQ ID NO: 802 - protein, 108 aa, Artificial Sequence
  synthetic
DIQMTQSPSSLSASVGDRVTITCRASQSISNYLNWYQQKPGKAPKLLIYAASSLQSGVPSRFSGSESGTDFTLTISSLQPEDFATYYCQQSYSTPPTFGGGTKVEIKR

SEQ ID NO: 803 - DNA, 18 bp, Artificial Sequence
  synthetic
cagagcattagcaactat

SEQ ID NO: 804 - protein, 6 aa, Artificial Sequence
  synthetic
QSISNY

SEQ ID NO: 805 - DNA, 9 bp, Artificial Sequence
  synthetic
gctgcatcc

SEQ ID NO: 806 - protein, 3 aa, Artificial Sequence
  synthetic
AAS

SEQ ID NO: 807 - DNA, 27 bp, Artificial Sequence
  synthetic
caacagagttacagtacccctcccact

SEQ ID NO: 808 - protein, 9 aa, Artificial Sequence
  synthetic
QQSYSTPPT

SEQ ID NO: 809 - DNA, 360 bp, Artificial Sequence; identical to SEQ ID NO: 729
  synthetic

SEQ ID NO: 810 - protein, 120 aa, Artificial Sequence; identical to SEQ ID NO: 730
  synthetic

SEQ ID NO: 811 - DNA, 24 bp, Artificial Sequence
  synthetic
ggattcatctttagtagctattgg

SEQ ID NO: 812 - protein, 8 aa, Artificial Sequence
  synthetic
GFIFSSYW

SEQ ID NO: 813 - DNA, 24 bp, Artificial Sequence
  synthetic
ataaaacaagatggaactgagaaa

SEQ ID NO: 814 - protein, 8 aa, Artificial Sequence
  synthetic
IKQDGTEK

SEQ ID NO: 815 - DNA, 39 bp, Artificial Sequence; identical to SEQ ID NO: 671
  synthetic

SEQ ID NO: 816 - protein, 13 aa, Artificial Sequence
  synthetic
ARDHPVGAPFFDY

SEQ ID NO: 817 - DNA, 324 bp, Artificial Sequence; identical to SEQ ID NO: 705
  synthetic

SEQ ID NO: 818 - protein, 108 aa, Artificial Sequence; identical to SEQ ID NO: 706
  synthetic

SEQ ID NO: 819 - DNA, 18 bp, Artificial Sequence
  synthetic
cagagcattagttactat

SEQ ID NO: 820 - protein, 6 aa, Artificial Sequence
  synthetic
QSISYY

SEQ ID NO: 821 - DNA, 9 bp, Artificial Sequence
  synthetic
agtacatcc

SEQ ID NO: 822 - protein, 3 aa, Artificial Sequence
  synthetic
STS

SEQ ID NO: 823 - DNA, 27 bp, Artificial Sequence
  synthetic
caacagagttacagtaccccgtacact

SEQ ID NO: 824 - protein, 9 aa, Artificial Sequence
  synthetic
QQSYSTPYT

SEQ ID NO: 825 - DNA, 366 bp, Artificial Sequence
  synthetic
caggtgcagctggtggagtctggcgcaggactgttgaagccttcggagaccctgtccctcacctgcgctgtctatggtgggtccttcagtggtttctactggacctggatccgccagcccccagggaaggggctggagtggattggggaaatcagtcatagtggaaacaccgactacatcccgtccctcaagagtcgagtcaccatatcattagacacgtccaagaaccagttctccctgaagctgaactctgtgaccgccgcggacacggctttttattactgtgcgagaggtcctttttacgatattttgactggttacccctttgactactggggccagggaaccctggtcaccgtctcctca

SEQ ID NO: 826 - protein, 122 aa, Artificial Sequence
  synthetic
QVQLVESGAGLLKPSETLSLTCAVYGGSFSGFYWTWIRQPPGKGLEWIGEISHSGNTDYIPSLKSRVTISLDTSKNQFSLKLNSVTAADTAFYYCARGPFYDILTGYPFDYWGQGTLVTVSS

SEQ ID NO: 827 - DNA, 24 bp, Artificial Sequence
  synthetic
ggtgggtccttcagtggtttctac

SEQ ID NO: 828 - protein, 8 aa, Artificial Sequence
  synthetic
GGSFSGFY

SEQ ID NO: 829 - DNA, 21 bp, Artificial Sequence
  synthetic
atcagtcatagtggaaacacc

SEQ ID NO: 830 - protein, 7 aa, Artificial Sequence
  synthetic
ISHSGNT

SEQ ID NO: 831 - DNA, 48 bp, Artificial Sequence; identical to SEQ ID NO: 687
  synthetic

SEQ ID NO: 832 - protein, 16 aa, Artificial Sequence
  synthetic
ARGPFYDILTGYPFDY

SEQ ID NO: 833 - DNA, 324 bp, Artificial Sequence; identical to SEQ ID NO: 625
  synthetic

SEQ ID NO: 834 - protein, 108 aa, Artificial Sequence; identical to SEQ ID NO: 626
  synthetic

SEQ ID NO: 835 - DNA, 18 bp, Artificial Sequence
  synthetic
cagagtgttagcagcaac

SEQ ID NO: 836 - protein, 6 aa, Artificial Sequence
  synthetic
QSVSSN

SEQ ID NO: 837 - DNA, 9 bp, Artificial Sequence
  synthetic
ggtgcatcc

SEQ ID NO: 838 - protein, 3 aa, Artificial Sequence
  synthetic
GAS

SEQ ID NO: 839 - DNA, 27 bp, Artificial Sequence
  synthetic
cagcagtataataactggcctctcact

SEQ ID NO: 840 - protein, 9 aa, Artificial Sequence
  synthetic
QQYNNWPLT

SEQ ID NO: 841 - DNA, 366 bp, Artificial Sequence
  synthetic
gaggtgcagctggtggagtcgggcccaggactggtgaagccttcggagaccctgtccctcacctgcactgtctctggtggctccatcagtaattactattggagctggatccgacagcccccagggaagggactggagtggattgggtatatctattacagtgggaacaccaagtacaacccctccctcaagagtcgagtcatcatatcagtagacacgtccaagaaccagttctccctgaacctgacgtctgtgaccactgcggacacggccgtgtattactgtgcgagagatatagtggctgcgattaggcctcactggtacttcgatctctggggccgtggcaccacggtcaccgtctcctca

SEQ ID NO: 842 - protein, 122 aa, Artificial Sequence
  synthetic
EVQLVESGPGLVKPSETLSLTCTVSGGSISNYYWSWIRQPPGKGLEWIGYIYYSGNTKYNPSLKSRVIISVDTSKNQFSLNLTSVTTADTAVYYCARDIVAAIRPHWYFDLWGRGTTVTVSS

SEQ ID NO: 843 - DNA, 24 bp, Artificial Sequence
  synthetic
ggtggctccatcagtaattactat

SEQ ID NO: 844 - protein, 8 aa, Artificial Sequence
  synthetic
GGSISNYY

SEQ ID NO: 845 - DNA, 21 bp, Artificial Sequence
  synthetic
atctattacagtgggaacacc

SEQ ID NO: 846 - protein, 7 aa, Artificial Sequence
  synthetic
IYYSGNT

SEQ ID NO: 847 - DNA, 48 bp, Artificial Sequence; identical to SEQ ID NO: 767
  synthetic

SEQ ID NO: 848 - protein, 16 aa, Artificial Sequence
  synthetic
ARDIVAAIRPHWYFDL

SEQ ID NO: 849 - DNA, 324 bp, Artificial Sequence
  synthetic
gacatcctgatgacccagtctccatcctccctgtctgcgtctgtaggagacagagtcaccatcacttgccgggcaagtcagaccattaacaactatttaaattggtatcagcaatatccaggaaaagcccctaaagtcctgatctatgctgcatccattttgctaagtggggtcccatccagattcagtggcagtggatctgggacagatttcactctcaccatcagcagtctgcaacctgaagattttgcaacttacttctgtcaacagagttacagtatccctcccactttcggcggagggaccaaggtggagatcaaacga

SEQ ID NO: 850 - protein, 108 aa, Artificial Sequence
  synthetic
DILMTQSPSSLSASVGDRVTITCRASQTINNYLNWYQQYPGKAPKVLIYAASILLSGVPSRFSGSGSGTDFTLTISSLQPEDFATYFCQQSYSIPPTFGGGTKVEIKR

SEQ ID NO: 851 - DNA, 18 bp, Artificial Sequence
  synthetic
cagaccattaacaactat

SEQ ID NO: 852 - protein, 6 aa, Artificial Sequence
  synthetic
QTINNY

SEQ ID NO: 853 - DNA, 9 bp, Artificial Sequence
  synthetic
gctgcatcc

SEQ ID NO: 854 - protein, 3 aa, Artificial Sequence
  synthetic
AAS

SEQ ID NO: 855 - DNA, 27 bp, Artificial Sequence
  synthetic
caacagagttacagtatccctcccact

SEQ ID NO: 856 - protein, 9 aa, Artificial Sequence
  synthetic
QQSYSIPPT

SEQ ID NO: 857 - DNA, 366 bp, Artificial Sequence
  synthetic
gaggtgcagctggtggagtcgggcccaggactggtgaagccttcggagaccctgtccctcacctgcactgtctctggtggctccatcagtaattactactggagctggatccgacagcccccagggaagggactggagtggattgggtatatctattacagtgggaacaccaagtacaacccctccctcaagagtcgagtcaccatatcagtagacacgtccaagaaccagttctccctgaacctgacgtctgtgaccactgcggacacggccgtgtattactgtgcgagagatatagtggctgcgattaggcctcactggtacttcgatctctggggccgtggcaccacggtcaccgtctcctca

SEQ ID NO: 858 - protein, 122 aa, Artificial Sequence
  synthetic
EVQLVESGPGLVKPSETLSLTCTVSGGSISNYYWSWIRQPPGKGLEWIGYIYYSGNTKYNPSLKSRVTISVDTSKNQFSLNLTSVTTADTAVYYCARDIVAAIRPHWYFDLWGRGTTVTVSS

SEQ ID NO: 859 - DNA, 24 bp, Artificial Sequence
  synthetic
ggtggctccatcagtaattactac

SEQ ID NO: 860 - protein, 8 aa, Artificial Sequence
  synthetic
GGSISNYY

SEQ ID NO: 861 - DNA, 21 bp, Artificial Sequence
  synthetic
atctattacagtgggaacacc

SEQ ID NO: 862 - protein, 7 aa, Artificial Sequence
  synthetic
IYYSGNT

SEQ ID NO: 863 - DNA, 48 bp, Artificial Sequence; identical to SEQ ID NO: 767
  synthetic

SEQ ID NO: 864 - protein, 16 aa, Artificial Sequence
  synthetic
ARDIVAAIRPHWYFDL

SEQ ID NO: 865 - DNA, 324 bp, Artificial Sequence
  synthetic
gacatcctgatgacccagtctccatcctccctgtctgcgtctgtaggagacagagtcaccatcacttgccgggcaagtcagaccattaacacctatttaaattggtatcagcagaatccagggaaagcccctaaggtcctgatctatggtacatccattttgctaagtggggtcccatccagattcagtggcagtggatctgggacagatttcactctcaccatcagcagtctgcaacctgaagattttacaagttacttctgtcaacagagttacagtatccctcccactttcggcggagggaccaaggtggagatcaaacga

SEQ ID NO: 866 - protein, 108 aa, Artificial Sequence
  synthetic
DILMTQSPSSLSASVGDRVTITCRASQTINTYLNWYQQNPGKAPKVLIYGTSILLSGVPSRFSGSGSGTDFTLTISSLQPEDFTSYFCQQSYSIPPTFGGGTKVEIKR

SEQ ID NO: 867 - DNA, 18 bp, Artificial Sequence
  synthetic
cagaccattaacacctat

SEQ ID NO: 868 - protein, 6 aa, Artificial Sequence
  synthetic
QTINTY

SEQ ID NO: 869 - DNA, 9 bp, Artificial Sequence
  synthetic
ggtacatcc

SEQ ID NO: 870 - protein, 3 aa, Artificial Sequence
  synthetic
GTS

SEQ ID NO: 871 - DNA, 27 bp, Artificial Sequence
  synthetic
caacagagttacagtatccctcccact

SEQ ID NO: 872 - protein, 9 aa, Artificial Sequence
  synthetic
QQSYSIPPT

SEQ ID NO: 873 - DNA, 354 bp, Artificial Sequence
  synthetic
gaggtgcagctggtggagtctgggggaggcttggtacagcctggggggtccctgagactctcctgtgcagcctctggattcacctttagcagctatgccatgagctgggtccgccaggctccaggaaaggggctggagtgggtctcaggtattagtggtagtggcactcacacatactacacagactccgtgaagggccggttcaccatctccagagacaattccaaggacaggctctatctgcaaatgaacagtctgagagccgaagacacggccgtatattactgtgcgaaagagggcctcctctattatttcaatttctggggccgtggcaccacggtcaccgtctcctca

SEQ ID NO: 874 - protein, 118 aa, Artificial Sequence
  synthetic
EVQLVESGGGLVQPGGSLRLSCAASGFTFSSYAMSWVRQAPGKGLEWVSGISGSGTHTYYTDSVKGRFTISRDNSKDRLYLQMNSLRAEDTAVYYCAKEGLLYYFNFWGRGTTVTVSS

SEQ ID NO: 875 - DNA, 24 bp, Artificial Sequence
  synthetic
ggattcacctttagcagctatgcc

SEQ ID NO: 876 - protein, 8 aa, Artificial Sequence
  synthetic
GFTFSSYA

SEQ ID NO: 877 - DNA, 24 bp, Artificial Sequence
  synthetic
attagtggtagtggcactcacaca

SEQ ID NO: 878 - protein, 8 aa, Artificial Sequence
  synthetic
ISGSGTHT

SEQ ID NO: 879 - DNA, 33 bp, Artificial Sequence
  synthetic
gcgaaagagggcctcctctattatttcaatttc

SEQ ID NO: 880 - protein, 11 aa, Artificial Sequence
  synthetic
AKEGLLYYFNF

SEQ ID NO: 881 - DNA, 324 bp, Artificial Sequence
  synthetic
gacatcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactgctgtcaacagagttacagtaccccattcactttcggccctgggaccaaggtggagatcaaacga

SEQ ID NO: 882 - protein, 108 aa, Artificial Sequence
  synthetic
DIVMTQSPSSLSASVGDRVTITCRASQSISSYLNWYQQKPGKAPKLLIYAASSLQSGVPSRFSGSGSGTDFTLTISSLQPEDFATYCCQQSYSTPFTFGPGTKVEIKR

SEQ ID NO: 883 - DNA, 18 bp, Artificial Sequence
  synthetic
cagagcattagcagctat

SEQ ID NO: 884 - protein, 6 aa, Artificial Sequence
  synthetic
QSISSY

SEQ ID NO: 885 - DNA, 9 bp, Artificial Sequence
  synthetic
gctgcatcc

SEQ ID NO: 886 - protein, 3 aa, Artificial Sequence
  synthetic
AAS

SEQ ID NO: 887 - DNA, 27 bp, Artificial Sequence
  synthetic
caacagagttacagtaccccattcact

SEQ ID NO: 888 - protein, 9 aa, Artificial Sequence
  synthetic
QQSYSTPFT

SEQ ID NO: 889 - DNA, 375 bp, Artificial Sequence
  synthetic
gaggtgcagctggtggagtctgggggggacttggtacagcctggcaggtccctgagactctcctgtgcagcctctggattcacctttgatgattatgccatgcactgggtccggcaagctccagggaagggcctggagtgggtctcaggtattagttggaatagtggtagtctagactatgcggactctgtgaagggccgattcaccatctccagagacaatgccaagaactccctgtatctgcaaatgaacagtctgagaactgaggacacggccttgtattactgtgcaaaagatacgggtatagcagcaggtgccgactactactacggtctggacgtctggggccaagggaccacggtcaccgtctcctca

SEQ ID NO: 890 - protein, 125 aa, Artificial Sequence
  synthetic
EVQLVESGGDLVQPGRSLRLSCAASGFTFDDYAMHWVRQAPGKGLEWVSGISWNSGSLDYADSVKGRFTISRDNAKNSLYLQMNSLRTEDTALYYCAKDTGIAAGADYYYGLDVWGQGTTVTVSS

SEQ ID NO: 891 - DNA, 24 bp, Artificial Sequence
  synthetic
ggattcacctttgatgattatgcc

SEQ ID NO: 892 - protein, 8 aa, Artificial Sequence
  synthetic
GFTFDDYA

SEQ ID NO: 893 - DNA, 24 bp, Artificial Sequence
  synthetic
attagttggaatagtggtagtcta

SEQ ID NO: 894 - protein, 8 aa, Artificial Sequence
  synthetic
ISWNSGSL

SEQ ID NO: 895 - DNA, 54 bp, Artificial Sequence
  synthetic
gcaaaagatacgggtatagcagcaggtgccgactactactacggtctggacgtc

SEQ ID NO: 896 - protein, 18 aa, Artificial Sequence
  synthetic
AKDTGIAAGADYYYGLDV

SEQ ID NO: 897 - DNA, 324 bp, Artificial Sequence
  synthetic
gacatcctgatgacccagtctccatcctccctgtctgcatctgttggagacagagtcaccatcacttgccgggcgagtcagggcattaccaattttttagcctggtatcagcagataccagggagagttcctaagctcctgatctatgctgcatccactttgcaatcaggggtcccatctcggttcagtggcagtggatctgggacagatttcactctcaccatcagcaaccttcagcctgaagatgttgcaacttattactgtcaaacctataacagtgccccgctcactttcggcggggggaccaaggtggagatcaaacga

SEQ ID NO: 898 - protein, 108 aa, Artificial Sequence
  synthetic
DILMTQSPSSLSASVGDRVTITCRASQGITNFLAWYQQIPGRVPKLLIYAASTLQSGVPSRFSGSGSGTDFTLTISNLQPEDVATYYCQTYNSAPLTFGGGTKVEIKR

SEQ ID NO: 899 - DNA, 18 bp, Artificial Sequence
  synthetic
cagggcattaccaatttt

SEQ ID NO: 900 - protein, 6 aa, Artificial Sequence
  synthetic
QGITNF

SEQ ID NO: 901 - DNA, 9 bp, Artificial Sequence
  synthetic
gctgcatcc

SEQ ID NO: 902 - protein, 3 aa, Artificial Sequence
  synthetic
AAS

SEQ ID NO: 903 - DNA, 27 bp, Artificial Sequence
  synthetic
caaacctataacagtgccccgctcact

SEQ ID NO: 904 - protein, 9 aa, Artificial Sequence
  synthetic
QTYNSAPLT

SEQ ID NO: 905 - DNA, 363 bp, Artificial Sequence
  synthetic
caggtgcagctggtgcagtggggcgcaggactgttgaagccttcggagaccctgtccctcacctgcgctgtctatggtgggtccttcagtggttacgactggagctggatccgccagcccccagggaaggggctggagtggattggggaaatcaaacttagtggaagcaccaattacaatccgtccctcaagagtcgagtcactatatcactagacacgtccaagaaccagttctccctgaagctgagctctgtgaccgccgcggacacggctgtgtattactgtgcgagagtccctatgactataggctactactacggtttggacgtctggggccaggggaccacggtcaccgtctcctca

SEQ ID NO: 906 - protein, 121 aa, Artificial Sequence
  synthetic
QVQLVQWGAGLLKPSETLSLTCAVYGGSFSGYDWSWIRQPPGKGLEWIGEIKLSGSTNYNPSLKSRVTISLDTSKNQFSLKLSSVTAADTAVYYCARVPMTIGYYYGLDVWGQGTTVTVSS

SEQ ID NO: 907 - DNA, 24 bp, Artificial Sequence
  synthetic
ggtgggtccttcagtggttacgac

SEQ ID NO: 908 - protein, 8 aa, Artificial Sequence
  synthetic
GGSFSGYD

SEQ ID NO: 909 - DNA, 21 bp, Artificial Sequence
  synthetic
atcaaacttagtggaagcacc

SEQ ID NO: 910 - protein, 7 aa, Artificial Sequence
  synthetic
IKLSGST

SEQ ID NO: 911 - DNA, 45 bp, Artificial Sequence
  synthetic
gcgagagtccctatgactataggctactactacggtttggacgtc

SEQ ID NO: 912 - protein, 15 aa, Artificial Sequence
  synthetic
ARVPMTIGYYYGLDV

SEQ ID NO: 913 - DNA, 324 bp, Artificial Sequence
  synthetic
gacatcctgatgacccagtctccatcctccctgtctgcatctgtgggagacagagtcaccatcacttgccgggcgagtcagggcattagcaattatttagcctggtatcagcagaaaccagggaaagttcctcagctcctgatctatgctgcatccactttgcagtcaggggtcccatctcggttcagtggcagtggatctgggacagatttcactctcaccatcagcagcctgcagcctgaagatgttgctacttattactgtcaaaagtatgccggtgcccctcggacgttcggccaggggaccaaggtggagatcaaacga

SEQ ID NO: 914 - protein, 108 aa, Artificial Sequence
  synthetic
DILMTQSPSSLSASVGDRVTITCRASQGISNYLAWYQQKPGKVPQLLIYAASTLQSGVPSRFSGSGSGTDFTLTISSLQPEDVATYYCQKYAGAPRTFGQGTKVEIKR

SEQ ID NO: 915 - DNA, 18 bp, Artificial Sequence
  synthetic
cagggcattagcaattat

SEQ ID NO: 916 - protein, 6 aa, Artificial Sequence
  synthetic
QGISNY

SEQ ID NO: 917 - DNA, 9 bp, Artificial Sequence
  synthetic
gctgcatcc

SEQ ID NO: 918 - protein, 3 aa, Artificial Sequence
  synthetic
AAS

SEQ ID NO: 919 - DNA, 27 bp, Artificial Sequence
  synthetic
caaaagtatgccggtgcccctcggacg

SEQ ID NO: 920 - protein, 9 aa, Artificial Sequence
  synthetic
QKYAGAPRT

SEQ ID NO: 921 - DNA, 366 bp, Artificial Sequence
  synthetic
caggtgcagctggtggagtcgggcccaggactggtgaagtcttcggcgaccctgtcccttatctgcactgtctctggtggctccataagtagttactactggagctggatccggcagcccccagggaagggactggagtggattgggtatatcaattacagtgggagcaccaactacaacccctccctcaagagtcgagtcaccattttagtagacacgtccaagaaccacttctccctgaagctgagttctgtgaccgttgcggacacggccgtatattactgtgcgagaggggccagtaaccctgattattactactacggtatggacgtctggggccaagggaccacggtcaccgtctcctca

SEQ ID NO: 922 - protein, 122 aa, Artificial Sequence
  synthetic
QVQLVESGPGLVKSSATLSLICTVSGGSISSYYWSWIRQPPGKGLEWIGYINYSGSTNYNPSLKSRVTILVDTSKNHFSLKLSSVTVADTAVYYCARGASNPDYYYYGMDVWGQGTTVTVSS

SEQ ID NO: 923 - DNA, 24 bp, Artificial Sequence
  synthetic
ggtggctccataagtagttactac

SEQ ID NO: 924 - protein, 8 aa, Artificial Sequence
  synthetic
GGSISSYY

SEQ ID NO: 925 - DNA, 21 bp, Artificial Sequence
  synthetic
atcaattacagtgggagcacc

SEQ ID NO: 926 - protein, 7 aa, Artificial Sequence
  synthetic
INYSGST

SEQ ID NO: 927 - DNA, 48 bp, Artificial Sequence
  synthetic
gcgagaggggccagtaaccctgattattactactacggtatggacgtc

SEQ ID NO: 928 - protein, 16 aa, Artificial Sequence
  synthetic
ARGASNPDYYYYGMDV

SEQ ID NO: 929 - DNA, 342 bp, Artificial Sequence
  synthetic
gacatcctgatgacccagtctccagactccctggctgtgtctctgggcgagagggcctccatcaactgcaagtccagccataatgttttatacagctccaacaataagaactacttagcttggtatcagcagacaccaggtcagcctcctaaattactcatttactgggcatctacccgggaatccggggtccctgaccgattccgtggcagcgggtctgggacagatttcactctcaccatcagcagcctgcaggctgaggatgtggcagtttatttctgtcagcagtattataatactccgtggacgttcggccaagggaccaaggtggagatcaaacga

SEQ ID NO: 930 - protein, 114 aa, Artificial Sequence
  synthetic
DILMTQSPDSLAVSLGERASINCKSSHNVLYSSNNKNYLAWYQQTPGQPPKLLIYWASTRESGVPDRFRGSGSGTDFTLTISSLQAEDVAVYFCQQYYNTPWTFGQGTKVEIKR

SEQ ID NO: 931 - DNA, 36 bp, Artificial Sequence
  synthetic
cataatgttttatacagctccaacaataagaactac

SEQ ID NO: 932 - protein, 12 aa, Artificial Sequence
  synthetic
HNVLYSSNNKNY

SEQ ID NO: 933 - DNA, 9 bp, Artificial Sequence
  synthetic
tgggcatct

SEQ ID NO: 934 - protein, 3 aa, Artificial Sequence
  synthetic
WAS

SEQ ID NO: 935 - DNA, 27 bp, Artificial Sequence
  synthetic
cagcagtattataatactccgtggacg

SEQ ID NO: 936 - protein, 9 aa, Artificial Sequence
  synthetic
QQYYNTPWT

SEQ ID NO: 937 - DNA, 348 bp, Artificial Sequence
  synthetic
gaggtgcagctggtggagtctgggggaggcttggtccagccgggggggtccctgagactctcctgtgtagcctctggattcccctttagtagcttttggatgagctgggtccgccaggctccagggaaggggctggagtgggtggccaacatgaaacaggatggaagtgagaaatactatgtggactctgtgaagggccgattcaccctctccagagacaacggcaagaactcagtgtatctgcaaatgaacagcctgagagccgaggacacggctgtgtattactgtgcgagagataacttcccctttgactattggggccagggaaccctggtcaccgtctcctca

SEQ ID NO: 938 - protein, 116 aa, Artificial Sequence
  synthetic
EVQLVESGGGLVQPGGSLRLSCVASGFPFSSFWMSWVRQAPGKGLEWVANMKQDGSEKYYVDSVKGRFTLSRDNGKNSVYLQMNSLRAEDTAVYYCARDNFPFDYWGQGTLVTVSS

SEQ ID NO: 939 - DNA, 24 bp, Artificial Sequence
  synthetic
ggattcccctttagtagcttttgg

SEQ ID NO: 940 - protein, 8 aa, Artificial Sequence
  synthetic
GFPFSSFW

SEQ ID NO: 941 - DNA, 24 bp, Artificial Sequence
  synthetic
atgaaacaggatggaagtgagaaa

SEQ ID NO: 942 - protein, 8 aa, Artificial Sequence
  synthetic
MKQDGSEK

SEQ ID NO: 943 - DNA, 27 bp, Artificial Sequence
  synthetic
gcgagagataacttcccctttgactat

SEQ ID NO: 944 - protein, 9 aa, Artificial Sequence
  synthetic
ARDNFPFDY

SEQ ID NO: 945 - DNA, 324 bp, Artificial Sequence
  synthetic
gacatcctgatgacccagtctccatcctccctgtctgcatctgtaggagacagagtcaccatcacttgccgggcgagtcagggcattagcagttatttagcctggtatcagcagaaaccagggaaagttcctaagctcctgatctatgttgcatccactttgcaatcaggggtcccatctcggttcagtggcagtggatctggaacagatttcactctcaccatcagcagcctgcagcctgaagatgttgcaacttattactgtcacaagtataacagtgccccgtggacattcggccaagggaccaaggtggagatcaaacga

SEQ ID NO: 946 - protein, 108 aa, Artificial Sequence
  synthetic
DILMTQSPSSLSASVGDRVTITCRASQGISSYLAWYQQKPGKVPKLLIYVASTLQSGVPSRFSGSGSGTDFTLTISSLQPEDVATYYCHKYNSAPWTFGQGTKVEIKR

SEQ ID NO: 947 - DNA, 18 bp, Artificial Sequence
  synthetic
cagggcattagcagttat

SEQ ID NO: 948 - protein, 6 aa, Artificial Sequence
  synthetic
QGISSY

SEQ ID NO: 949 - DNA, 9 bp, Artificial Sequence
  synthetic
gttgcatcc

SEQ ID NO: 950 - protein, 3 aa, Artificial Sequence
  synthetic
VAS

SEQ ID NO: 951 - DNA, 27 bp, Artificial Sequence
  synthetic
cacaagtataacagtgccccgtggaca

SEQ ID NO: 952 - protein, 9 aa, Artificial Sequence
  synthetic
HKYNSAPWT

SEQ ID NO: 953 - DNA, 369 bp, Artificial Sequence
  synthetic
caggtgcagctggtggagtcaggtccaggactggtgaggccctcgcagaccctctcactcacctgtgccatctccggggacagcgtctctaccaacagtggtgcttggaactgggtcaggcagtccccatcgagaggccttgagtggctggggaggacatactacaggtccaagtggtatgatgaatatgcagtatctatgaaaagtcgaatgaccatcaacccagacacatccaagaaccagttctccctgcagatgaactctgtgactcccgaggacacggctgtctatttctgtgcaagagaacgcagctggttctctgacgcttttgatatttggggccaagggacaatggtcaccgtctcttca

SEQ ID NO: 954 - protein, 123 aa, Artificial Sequence
  synthetic
QVQLVESGPGLVRPSQTLSLTCAISGDSVSTNSGAWNWVRQSPSRGLEWLGRTYYRSKWYDEYAVSMKSRMTINPDTSKNQFSLQMNSVTPEDTAVYFCARERSWFSDAFDIWGQGTMVTVSS

SEQ ID NO: 955 - DNA, 30 bp, Artificial Sequence
  synthetic
ggggacagcgtctctaccaacagtggtgct

SEQ ID NO: 956 - protein, 10 aa, Artificial Sequence
  synthetic
GDSVSTNSGA

SEQ ID NO: 957 - DNA, 27 bp, Artificial Sequence
  synthetic
acatactacaggtccaagtggtatgat

SEQ ID NO: 958 - protein, 9 aa, Artificial Sequence
  synthetic
TYYRSKWYD

SEQ ID NO: 959 - DNA, 39 bp, Artificial Sequence
  synthetic
gcaagagaacgcagctggttctctgacgcttttgatatt

SEQ ID NO: 960 - protein, 13 aa, Artificial Sequence
  synthetic
ARERSWFSDAFDI

SEQ ID NO: 961 - DNA, 321 bp, Artificial Sequence
  synthetic
gacatccagttgacccagtctccttccatcctgtctgcatctgtaggagacagagtcaccatcacttgccgggccagtcagagtattagtacctggttggcctggtatcagcagaaaccaggaaaagcccctaaactcctgatctatgaggcgtctagtttagaaagtggggtcccatcaaggttcagcggcagtagatctgggacagacttcactctcaccatcagcagcctgcagcctgatgattttgcaacttattactgccaacagtataatactttttggacgttcggccaagggaccaaggtggagatcaaacga

SEQ ID NO: 962 - protein, 107 aa, Artificial Sequence
  synthetic
DIQLTQSPSILSASVGDRVTITCRASQSISTWLAWYQQKPGKAPKLLIYEASSLESGVPSRFSGSRSGTDFTLTISSLQPDDFATYYCQQYNTFWTFGQGTKVEIKR

SEQ ID NO: 963 - DNA, 18 bp, Artificial Sequence
  synthetic
cagagtattagtacctgg

SEQ ID NO: 964 - protein, 6 aa, Artificial Sequence
  synthetic
QSISTW

SEQ ID NO: 965 - DNA, 9 bp, Artificial Sequence
  synthetic
gaggcgtct

SEQ ID NO: 966 - protein, 3 aa, Artificial Sequence
  synthetic
EAS

SEQ ID NO: 967 - DNA, 24 bp, Artificial Sequence
  synthetic
caacagtataatactttttggacg

SEQ ID NO: 968 - protein, 8 aa, Artificial Sequence
  synthetic
QQYNTFWT

SEQ ID NO: 969 - DNA, 366 bp, Artificial Sequence
  synthetic
gaggtgcagctggtggagtctgggggaggcgtggtacagccgggggggtccctgagactctcctgtacaacctctggattcatctttgatgattatgccatgcactgggtccggcaagctccagggaagggcctggagtgggtctcaggcattaattggaatagtggaaccatagactatgcagactctgtgaagggccgattcaccatctccagagacaacgccaagaaatccctgtatctgcaaatgaacagtctgagagctgaggacacggccttctattattgtataaaggatatattagtaccagatgcatgggggtatttcgatctctggggccgtggcaccctggtcaccgtctcctca

SEQ ID NO: 970 - protein, 122 aa, Artificial Sequence
  synthetic
EVQLVESGGGVVQPGGSLRLSCTTSGFIFDDYAMHWVRQAPGKGLEWVSGINWNSGTIDYADSVKGRFTISRDNAKKSLYLQMNSLRAEDTAFYYCIKDILVPDAWGYFDLWGRGTLVTVSS

SEQ ID NO: 971 - DNA, 24 bp, Artificial Sequence
  synthetic
ggattcatctttgatgattatgcc

SEQ ID NO: 972 - protein, 8 aa, Artificial Sequence
  synthetic
GFIFDDYA

SEQ ID NO: 973 - DNA, 24 bp, Artificial Sequence
  synthetic
attaattggaatagtggaaccata

SEQ ID NO: 974 - protein, 8 aa, Artificial Sequence
  synthetic
INWNSGTI

SEQ ID NO: 975 - DNA, 45 bp, Artificial Sequence
  synthetic
ataaaggatatattagtaccagatgcatgggggtatttcgatctc

SEQ ID NO: 976 - protein, 15 aa, Artificial Sequence
  synthetic
IKDILVPDAWGYFDL

SEQ ID NO: 977 - DNA, 327 bp, Artificial Sequence
  synthetic
gacatcgtgatgacccagtctccaggcaccctgtctttgtctccaggggaaagagccaccctctcctgtagggccagtcagagtgttagcagcacctacttagcctggtaccagcagaaacctggccagtctcccaggctcctcatctatggtgcatccagcagggccactggcatcccagacaggttcagtggcagtgggtctgggacagacttcactctcaccatcagcagactggagcctgaagattttgcagtgtattactgtcaacattatggttactcaaaattcactttcggccctgggaccaaggtggagatcaaacga

SEQ ID NO: 978 - protein, 109 aa, Artificial Sequence
  synthetic
DIVMTQSPGTLSLSPGERATLSCRASQSVSSTYLAWYQQKPGQSPRLLIYGASSRATGIPDRFSGSGSGTDFTLTISRLEPEDFAVYYCQHYGYSKFTFGPGTKVEIKR

SEQ ID NO: 979 - DNA, 21 bp, Artificial Sequence
  synthetic
cagagtgttagcagcacctac

SEQ ID NO: 980 - protein, 7 aa, Artificial Sequence
  synthetic
QSVSSTY

SEQ ID NO: 981 - DNA, 9 bp, Artificial Sequence
  synthetic
ggtgcatcc

SEQ ID NO: 982 - protein, 3 aa, Artificial Sequence
  synthetic
GAS

SEQ ID NO: 983 - DNA, 27 bp, Artificial Sequence
  synthetic
caacattatggttactcaaaattcact

SEQ ID NO: 984 - protein, 9 aa, Artificial Sequence
  synthetic
QHYGYSKFT

SEQ ID NO: 985 - DNA, 369 bp, Artificial Sequence
  synthetic
gaggtgcagctggtggagtctgggggaggcttggttcagccagggcggtccctgagactctcctgttcagctgctggcttcacctttggtgattttgctatgagctgggtccgccaggctccagggaaggggctggagtgggtaggtttcattagaagcaacacttatggtgggacaacagaatacgccgtgtctgtgagaggcagattcaccatctcaagagatgattccaaaaatatcgcctatctgcaaatgaatagcctgaaaaccgaggacacagccgtgtatttctgtactagagagggcagggactacggtgactacgttcttgactactggggccagggaaccctggtcaccgtctcctca

SEQ ID NO: 986 - protein, 123 aa, Artificial Sequence
  synthetic
EVQLVESGGGLVQPGRSLRLSCSAAGFTFGDFAMSWVRQAPGKGLEWVGFIRSNTYGGTTEYAVSVRGRFTISRDDSKNIAYLQMNSLKTEDTAVYFCTREGRDYGDYVLDYWGQGTLVTVSS

SEQ ID NO: 987 - DNA, 24 bp, Artificial Sequence
  synthetic
ggcttcacctttggtgattttgct

SEQ ID NO: 988 - protein, 8 aa, Artificial Sequence
  synthetic
GFTFGDFA

SEQ ID NO: 989 - DNA, 30 bp, Artificial Sequence
  synthetic
attagaagcaacacttatggtgggacaaca

SEQ ID NO: 990 - protein, 10 aa, Artificial Sequence
  synthetic
IRSNTYGGTT

SEQ ID NO: 991 - DNA, 42 bp, Artificial Sequence
  synthetic
actagagagggcagggactacggtgactacgttcttgactac

SEQ ID NO: 992 - protein, 14 aa, Artificial Sequence
  synthetic
TREGRDYGDYVLDY

SEQ ID NO: 993 - DNA, 324 bp, Artificial Sequence
  synthetic
gacatccagatgacccagtctccatcctccctgtttgcatctgtaggagacagagtcaccatcacttgccgggcaagtcaggacattagaaatgatttaggctggtatcagcagaaaccagggaaagcccctaaactcctgatctatcttgcatccagtttgcaaagtggggtcccatcaaggttcagcggcagtggatttggcacagatttcactctcaccatcagcagcctgcagcctgaagattttgcaatttattactgtctacaagatttcacttacccgtggacgttcggccaagggaccaaggtggagatcaaacga

SEQ ID NO: 994 - protein, 108 aa, Artificial Sequence
  synthetic
DIQMTQSPSSLFASVGDRVTITCRASQDIRNDLGWYQQKPGKAPKLLIYLASSLQSGVPSRFSGSGFGTDFTLTISSLQPEDFAIYYCLQDFTYPWTFGQGTKVEIKR

SEQ ID NO: 995 - DNA, 18 bp, Artificial Sequence
  synthetic
caggacattagaaatgat

SEQ ID NO: 996 - protein, 6 aa, Artificial Sequence
  synthetic
QDIRND

SEQ ID NO: 997 - DNA, 9 bp, Artificial Sequence
  synthetic
cttgcatcc

SEQ ID NO: 998 - protein, 3 aa, Artificial Sequence
  synthetic
LAS

SEQ ID NO: 999 - DNA, 27 bp, Artificial Sequence
  synthetic
ctacaagatttcacttacccgtggacg

SEQ ID NO: 1000 - protein, 9 aa, Artificial Sequence
  synthetic
LQDFTYPWT

SEQ ID NO: 1001 - DNA, 366 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagtatggactatgcggactctgtgaagggccgattcaccatttccagagacaacgccaagaactccctgtatctgcaaatgaacagtctgagagctgaggacacggccttatattactgtataaaagatatattagtagcagatgcatgggggtggttcgatctctggggccgtggcaccctggtcaccgtctcctca

SEQ ID NO: 1002 - protein, 122 aa, Artificial Sequence
  synthetic
EVQLVESGGGLVQPGRSLRLSCAASGFTFDDYAMHWVRQAPGKGLEWVSGISWNSGSMDYADSVKGRFTISRDNAKNSLYLQMNSLRAEDTALYYCIKDILVADAWGWFDLWGRGTLVTVSS

SEQ ID NO: 1003 - DNA, 24 bp, Artificial Sequence
  synthetic
ggattcacctttgatgattatgcc

SEQ ID NO: 1004 - protein, 8 aa, Artificial Sequence
  synthetic
GFTFDDYA

SEQ ID NO: 1005 - DNA, 24 bp, Artificial Sequence
  synthetic
attagttggaatagtggtagtatg

SEQ ID NO: 1006 - protein, 8 aa, Artificial Sequence
  synthetic
ISWNSGSM

SEQ ID NO: 1007 - DNA, 45 bp, Artificial Sequence
  synthetic
ataaaagatatattagtagcagatgcatgggggtggttcgatctc

SEQ ID NO: 1008 - protein, 15 aa, Artificial Sequence
  synthetic
IKDILVADAWGWFDL

SEQ ID NO: 1009 - DNA, 327 bp, Artificial Sequence
  synthetic
gacattgtgatgacccagtctccaggcaccctgtctttgtctccaggggaaagagccaccctctcctgtagggccagtcagagtgttagcagcagctacctaacctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtatttctgtcagcactatgttaactcaaaattcactttcggccctgggaccaaggtggagatcaaacga

SEQ ID NO: 1010 - protein, 109 aa, Artificial Sequence
  synthetic
DIVMTQSPGTLSLSPGERATLSCRASQSVSSSYLTWYQQKPGQAPRLLIYGASSRATGIPDRFSGSGSGTDFTLTISRLEPEDFAVYFCQHYVNSKFTFGPGTKVEIKR

SEQ ID NO: 1011 - DNA, 21 bp, Artificial Sequence
  synthetic
cagagtgttagcagcagctac

SEQ ID NO: 1012 - protein, 7 aa, Artificial Sequence
  synthetic
QSVSSSY

SEQ ID NO: 1013 - DNA, 9 bp, Artificial Sequence
  synthetic
ggtgcatcc

SEQ ID NO: 1014 - protein, 3 aa, Artificial Sequence
  synthetic
GAS

SEQ ID NO: 1015 - DNA, 27 bp, Artificial Sequence
  synthetic
cagcactatgttaactcaaaattcact

SEQ ID NO: 1016 - protein, 9 aa, Artificial Sequence
  synthetic
QHYVNSKFT

SEQ ID NO: 1017 - DNA, 366 bp, Artificial Sequence
  synthetic
gaggtgcagctggtggagtcgggcccaggactggtgaagccttcggagaccctgtccctcacctgcactgtctctaatggctccatcagtacttactattggagctggatacggcagcccccagggaagggactggagtggattgggtatgtctattacagtgggaggaccaactacaatccctccctcaagagtcgagtcatcatatcagtagacacgcccaagaaccagttctccctgaaactgagttctgtgaccgctgcagacacggccgtgtattactgtgcgcgagatcttcatatagcagtgggtggctactggtacttcgatttctggggccgtggcaccctggtcaccgtctcctca

SEQ ID NO: 1018 - protein, 122 aa, Artificial Sequence
  synthetic
EVQLVESGPGLVKPSETLSLTCTVSNGSISTYYWSWIRQPPGKGLEWIGYVYYSGRTNYNPSLKSRVIISVDTPKNQFSLKLSSVTAADTAVYYCARDLHIAVGGYWYFDFWGRGTLVTVSS

SEQ ID NO: 1019 - DNA, 24 bp, Artificial Sequence
  synthetic
aatggctccatcagtacttactat

SEQ ID NO: 1020 - protein, 8 aa, Artificial Sequence
  synthetic
NGSISTYY

SEQ ID NO: 1021 - DNA, 21 bp, Artificial Sequence
  synthetic
gtctattacagtgggaggacc

SEQ ID NO: 1022 - protein, 7 aa, Artificial Sequence
  synthetic
VYYSGRT

SEQ ID NO: 1023 - DNA, 48 bp, Artificial Sequence
  synthetic
gcgcgagatcttcatatagcagtgggtggctactggtacttcgatttc

SEQ ID NO: 1024 - protein, 16 aa, Artificial Sequence
  synthetic
ARDLHIAVGGYWYFDF

SEQ ID NO: 1025 - DNA, 324 bp, Artificial Sequence
  synthetic
gacatccagatgacccagtctccatcctccctgtctgcatctgtaggagacagagtcaccatcacttgccgggcaagtcagagcattaacaactatttgaattggtatcagcagaaaccagggaaggcccctaagctcctgatctatgctgcatccactttacaaagtggggtcccatcaaggttcagtggcagtggatctgggacaactttcactctcaccatcaacagtctgcaacctgaagattttgcaacttacttctgtcaacaaatttacagtatcccgatcaccttcggccaggggaccaaactggagatcaaacga

SEQ ID NO: 1026 - protein, 108 aa, Artificial Sequence
  synthetic
DIQMTQSPSSLSASVGDRVTITCRASQSINNYLNWYQQKPGKAPKLLIYAASTLQSGVPSRFSGSGSGTTFTLTINSLQPEDFATYFCQQIYSIPITFGQGTKLEIKR

SEQ ID NO: 1027 - DNA, 18 bp, Artificial Sequence
  synthetic
cagagcattaacaactat

SEQ ID NO: 1028 - protein, 6 aa, Artificial Sequence
  synthetic
QSINNY

SEQ ID NO: 1029 - DNA, 9 bp, Artificial Sequence
  synthetic
gctgcatcc

SEQ ID NO: 1030 - protein, 3 aa, Artificial Sequence
  synthetic
AAS

SEQ ID NO: 1031 - DNA, 27 bp, Artificial Sequence
  synthetic
caacaaatttacagtatcccgatcacc

SEQ ID NO: 1032 - protein, 9 aa, Artificial Sequence
  synthetic
QQIYSIPIT

SEQ ID NO: 1033 - DNA, 369 bp, Artificial Sequence
  synthetic
caggtgcagctggtggagtcaggtccaggactggtgaagccctcgcagaccctctcactcacctgtgccatctccggggacagtgtctctaccaacagtggtgcttggaactggatcaggcagtccccatcgagaggccttgagtggctgggaaggacatactacaggtccaagtggtataatgactatgcagcatctgtgaaaagtcgaataaccatcagcccagacacatccaagaaccagttctccctgcagatgaactctgtgactcccgaggacacggctgtgtatttctgtgcaagagaacgcagctggttctctgacgcttttgatatctggggccaagggacaatggtcaccgtctcctca

SEQ ID NO: 1034 - protein, 123 aa, Artificial Sequence
  synthetic
QVQLVESGPGLVKPSQTLSLTCAISGDSVSTNSGAWNWIRQSPSRGLEWLGRTYYRSKWYNDYAASVKSRITISPDTSKNQFSLQMNSVTPEDTAVYFCARERSWFSDAFDIWGQGTMVTVSS

SEQ ID NO: 1035 - DNA, 30 bp, Artificial Sequence
  synthetic
ggggacagtgtctctaccaacagtggtgct

SEQ ID NO: 1036 - protein, 10 aa, Artificial Sequence
  synthetic
GDSVSTNSGA

SEQ ID NO: 1037 - DNA, 27 bp, Artificial Sequence
  synthetic
acatactacaggtccaagtggtataat

SEQ ID NO: 1038 - protein, 9 aa, Artificial Sequence
  synthetic
TYYRSKWYN

SEQ ID NO: 1039 - DNA, 39 bp, Artificial Sequence
  synthetic
gcaagagaacgcagctggttctctgacgcttttgatatc

SEQ ID NO: 1040 - protein, 13 aa, Artificial Sequence
  synthetic
ARERSWFSDAFDI

SEQ ID NO: 1041 - DNA, 321 bp, Artificial Sequence
  synthetic
gacatcctgatgacccagtctccttccaccctgtctgcatctgtaggaaacagaatcaccatcacttgccgggccagtcagagtattagtgcctggttggcctggtatcagcagaaaccagggaaagcccctaaactcctgatctataaggcgtctagtttagaaagtggggtcccatcaaggttcagcggcagtggatctgggacagaattcactctcaccatcagcagcctgcagcctgatgattttgcaacttattactgccaacagtataatacttattggacgttcggccaagggaccaaggtggagatcaaacga

SEQ ID NO: 1042 - protein, 107 aa, Artificial Sequence
  synthetic
DILMTQSPSTLSASVGNRITITCRASQSISAWLAWYQQKPGKAPKLLIYKASSLESGVPSRFSGSGSGTEFTLTISSLQPDDFATYYCQQYNTYWTFGQGTKVEIKR

SEQ ID NO: 1043 - DNA, 18 bp, Artificial Sequence
  synthetic
cagagtattagtgcctgg

SEQ ID NO: 1044 - protein, 6 aa, Artificial Sequence
  synthetic
QSISAW

SEQ ID NO: 1045 - DNA, 9 bp, Artificial Sequence
  synthetic
aaggcgtct

SEQ ID NO: 1046 - protein, 3 aa, Artificial Sequence
  synthetic
KAS

SEQ ID NO: 1047 - DNA, 24 bp, Artificial Sequence
  synthetic
caacagtataatacttattggacg

SEQ ID NO: 1048 - protein, 8 aa, Artificial Sequence
  synthetic
QQYNTYWT

SEQ ID NO: 1049 - DNA, 366 bp, Artificial Sequence
  synthetic
caggtgcagctggtggagtctgggggaggcttggtacagcctggcaggtccctgagactctcctgtgcagcctctggattcacctttgatgattatgccatgcactgggtccggcaagcgccagggaagggcctggagtgggtctcaggtattagttggaatagtgattatatagactatgcggactctgtgaagggccgattcaccatctccagagacaacgccaagaattccctgtatctgcagatgaacagtctgagatctgaggacacggccctgtattactgtgcaaaagatatattactaccagatgcatgggggtggttcgatctctggggccgtggcaccctggtcaccgtctcctca

SEQ ID NO: 1050 - protein, 122 aa, Artificial Sequence
  synthetic
QVQLVESGGGLVQPGRSLRLSCAASGFTFDDYAMHWVRQAPGKGLEWVSGISWNSDYIDYADSVKGRFTISRDNAKNSLYLQMNSLRSEDTALYYCAKDILLPDAWGWFDLWGRGTLVTVSS

SEQ ID NO: 1051 - DNA, 24 bp, Artificial Sequence
  synthetic
ggattcacctttgatgattatgcc

SEQ ID NO: 1052 - protein, 8 aa, Artificial Sequence
  synthetic
GFTFDDYA

SEQ ID NO: 1053 - DNA, 24 bp, Artificial Sequence
  synthetic
attagttggaatagtgattatata

SEQ ID NO: 1054 - protein, 8 aa, Artificial Sequence
  synthetic
ISWNSDYI

SEQ ID NO: 1055 - DNA, 45 bp, Artificial Sequence
  synthetic
gcaaaagatatattactaccagatgcatgggggtggttcgatctc

SEQ ID NO: 1056 - protein, 15 aa, Artificial Sequence
  synthetic
AKDILLPDAWGWFDL

SEQ ID NO: 1057 - DNA, 327 bp, Artificial Sequence
  synthetic
gacatcgtgatgacccagtctccagacaccctgtctttgtctccaggggaaagagccaccctctcctgcagggccagtcagcgtgttagcagtagctacttaacctggtaccagcagaaacctggccaggctcccaggctcctcatctatggtgcatccagcagggccactggcatcccagacaggttcagtggcagtgggtctgggacagacttcactctcaccatcagcagactggagtctgaagattctgcagtgtattactgccagcattttgttaactcaaaattcactttcggccctgggaccaaggtggagatcaaacga

SEQ ID NO: 1058 - protein, 109 aa, Artificial Sequence
  synthetic
DIVMTQSPDTLSLSPGERATLSCRASQRVSSSYLTWYQQKPGQAPRLLIYGASSRATGIPDRFSGSGSGTDFTLTISRLESEDSAVYYCQHFVNSKFTFGPGTKVEIKR

SEQ ID NO: 1059 - DNA, 21 bp, Artificial Sequence
  synthetic
cagcgtgttagcagtagctac

SEQ ID NO: 1060 - protein, 7 aa, Artificial Sequence
  synthetic
QRVSSSY

SEQ ID NO: 1061 - DNA, 9 bp, Artificial Sequence
  synthetic
ggtgcatcc

SEQ ID NO: 1062 - protein, 3 aa, Artificial Sequence
  synthetic
GAS

SEQ ID NO: 1063 - DNA, 27 bp, Artificial Sequence
  synthetic
cagcattttgttaactcaaaattcact

SEQ ID NO: 1064 - protein, 9 aa, Artificial Sequence
  synthetic
QHFVNSKFT

SEQ ID NO: 1065 - DNA, 369 bp, Artificial Sequence
  synthetic
caggtgcagctggtggagtctgggggaggcttggttcagccagggcggtccctgagactctcctgttcagctgctggattcacctttggtgattttgctatgagctgggtccgccaggctccagggaaggggctggagtgggtaggtttcattagaagcaacacttatggtgggacaacagaatacgccgtgtctgtgagaggcagattcaccatctcaagagatgattccaaaaatatcgcctatctgcaaatgaatagcctgaaaaccgaggacacagccgtgtattactgtactagagagggcagggactacggtgactacgttcttgactactggggccagggaaccatggtcaccgtctcctca

SEQ ID NO: 1066 - protein, 123 aa, Artificial Sequence
  synthetic
QVQLVESGGGLVQPGRSLRLSCSAAGFTFGDFAMSWVRQAPGKGLEWVGFIRSNTYGGTTEYAVSVRGRFTISRDDSKNIAYLQMNSLKTEDTAVYYCTREGRDYGDYVLDYWGQGTMVTVSS

SEQ ID NO: 1067 - DNA, 24 bp, Artificial Sequence
  synthetic
ggattcacctttggtgattttgct

SEQ ID NO: 1068 - protein, 8 aa, Artificial Sequence
  synthetic
GFTFGDFA

SEQ ID NO: 1069 - DNA, 30 bp, Artificial Sequence; identical to SEQ ID NO: 989
  synthetic

SEQ ID NO: 1070 - protein, 10 aa, Artificial Sequence
  synthetic
IRSNTYGGTT

SEQ ID NO: 1071 - DNA, 42 bp, Artificial Sequence; identical to SEQ ID NO: 991
  synthetic

SEQ ID NO: 1072 - protein, 14 aa, Artificial Sequence
  synthetic
TREGRDYGDYVLDY

SEQ ID NO: 1073 - DNA, 324 bp, Artificial Sequence
  synthetic
gacatcctgatgacccagtctccatcctccctgtgtgtatctgtaggagacagagtcaccatcacttgccgggcaagtcaggacattagaaatgatttaggctggtatcagcagaaaccagggaaagcccctaaactcctgatctatcttgcatccagtttgcaaagtggggtcccatcaaggttcagcggcagtggatttggcacagatttcagtctcaccatcagcagcctgcagcctgaagattttgcaatttactactgtctacaagatttcacttacccgtggacgttcggccaagggaccaaggtggagatcaaacga

SEQ ID NO: 1074 - protein, 108 aa, Artificial Sequence
  synthetic
DILMTQSPSSLCVSVGDRVTITCRASQDIRNDLGWYQQKPGKAPKLLIYLASSLQSGVPSRFSGSGFGTDFSLTISSLQPEDFAIYYCLQDFTYPWTFGQGTKVEIKR

SEQ ID NO: 1075 - DNA, 18 bp, Artificial Sequence
  synthetic
caggacattagaaatgat

SEQ ID NO: 1076 - protein, 6 aa, Artificial Sequence
  synthetic
QDIRND

SEQ ID NO: 1077 - DNA, 9 bp, Artificial Sequence
  synthetic
cttgcatcc

SEQ ID NO: 1078 - protein, 3 aa, Artificial Sequence
  synthetic
LAS

SEQ ID NO: 1079 - DNA, 27 bp, Artificial Sequence
  synthetic
ctacaagatttcacttacccgtggacg

SEQ ID NO: 1080 - protein, 9 aa, Artificial Sequence
  synthetic
LQDFTYPWT

SEQ ID NO: 1081 - DNA, 366 bp, Artificial Sequence
  synthetic
caggtgcagctggtggagtctgggggaggcgtggtacagccgggggggtccctgagactctcctgtacaacctctggattcatctttgatgattatgccatgcactgggtccggcaagctccagggaagggcctggagtgggtctcaggcattaattggaatagtggaaccatagactatgcagactcggtgaagggccgattcaccatctccagagacaacgccaagaaatccctgtatcttcaaatgaacagtctgagagctgaggacacggccttctattattgtataaaggatatattagtaccagatgcatgggggtatttcgatatttggggccgtggcaccctggtcaccgtctcctca

SEQ ID NO: 1082 - protein, 122 aa, Artificial Sequence
  synthetic
QVQLVESGGGVVQPGGSLRLSCTTSGFIFDDYAMHWVRQAPGKGLEWVSGINWNSGTIDYADSVKGRFTISRDNAKKSLYLQMNSLRAEDTAFYYCIKDILVPDAWGYFDIWGRGTLVTVSS

SEQ ID NO: 1083 - DNA, 24 bp, Artificial Sequence
  synthetic
ggattcatctttgatgattatgcc

SEQ ID NO: 1084 - protein, 8 aa, Artificial Sequence
  synthetic
GFIFDDYA

SEQ ID NO: 1085 - DNA, 24 bp, Artificial Sequence
  synthetic
attaattggaatagtggaaccata

SEQ ID NO: 1086 - protein, 8 aa, Artificial Sequence
  synthetic
INWNSGTI

SEQ ID NO: 1087 - DNA, 45 bp, Artificial Sequence
  synthetic
ataaaggatatattagtaccagatgcatgggggtatttcgatatt

SEQ ID NO: 1088 - protein, 15 aa, Artificial Sequence
  synthetic
IKDILVPDAWGYFDI

SEQ ID NO: 1089 - DNA, 327 bp, Artificial Sequence; identical to SEQ ID NO: 977
  synthetic

SEQ ID NO: 1090 - protein, 109 aa, Artificial Sequence; identical to SEQ ID NO: 978
  synthetic

SEQ ID NO: 1091 - DNA, 21 bp, Artificial Sequence
  synthetic
cagagtgttagcagcacctac

SEQ ID NO: 1092 - protein, 7 aa, Artificial Sequence
  synthetic
QSVSSTY

SEQ ID NO: 1093 - DNA, 9 bp, Artificial Sequence
  synthetic
ggtgcatcc

SEQ ID NO: 1094 - protein, 3 aa, Artificial Sequence
  synthetic
GAS

SEQ ID NO: 1095 - DNA, 27 bp, Artificial Sequence
  synthetic
caacattatggttactcaaaattcact

SEQ ID NO: 1096 - protein, 9 aa, Artificial Sequence
  synthetic
QHYGYSKFT

SEQ ID NO: 1097 - DNA, 366 bp, Artificial Sequence
  synthetic
gaggtgcagctggtggagtctgggggaggcttggtacagcctggcaggtccctgagactctcctgtgtagcctctggattcacctttgatgattatggcatgcactgggtccggcaagcgccagggaagggcctggagtgggtctcaggtattagttggaatagtgataatatggactatgcggactctgtgaagggccgattcaccatctccagagacaacgccaagaactccctgtatctgcaaatgcaaaatctgagatcagaggacacggccctgtattactgtgcaaaagatatattagttccagatgcatgggggtggttcgatctctggggccgtggcaccctggtcaccgtctcctca

SEQ ID NO: 1098 - protein, 122 aa, Artificial Sequence
  synthetic
EVQLVESGGGLVQPGRSLRLSCVASGFTFDDYGMHWVRQAPGKGLEWVSGISWNSDNMDYADSVKGRFTISRDNAKNSLYLQMQNLRSEDTALYYCAKDILVPDAWGWFDLWGRGTLVTVSS

SEQ ID NO: 1099 - DNA, 24 bp, Artificial Sequence
  synthetic
ggattcacctttgatgattatggc

SEQ ID NO: 1100 - protein, 8 aa, Artificial Sequence
  synthetic
GFTFDDYG

SEQ ID NO: 1101 - DNA, 24 bp, Artificial Sequence
  synthetic
attagttggaatagtgataatatg

SEQ ID NO: 1102 - protein, 8 aa, Artificial Sequence
  synthetic
ISWNSDNM

SEQ ID NO: 1103 - DNA, 45 bp, Artificial Sequence
  synthetic
gcaaaagatatattagttccagatgcatgggggtggttcgatctc

SEQ ID NO: 1104 - protein, 15 aa, Artificial Sequence
  synthetic
AKDILVPDAWGWFDL

SEQ ID NO: 1105 - DNA, 327 bp, Artificial Sequence
  synthetic
gacatcgtgatgacccagtctccagacaccctgtctttgtctccaggggaaagagccaccctctcctgcagggccagtcagcgtgttagcagcagccacttaacctggtaccagcagaaacctggccaggctcccaggctcctcatctttggtgcatccagcagggccactggcatcccagacaggttcagtggcagtgggtctgggacagacttcactctcaccatcagcagactggagcctgaagattttgcagtatattactgtcagcattttgttaactcaaaattcactttcggccctgggaccaaggtggagatcaaacga

SEQ ID NO: 1106 - protein, 109 aa, Artificial Sequence
  synthetic
DIVMTQSPDTLSLSPGERATLSCRASQRVSSSHLTWYQQKPGQAPRLLIFGASSRATGIPDRFSGSGSGTDFTLTISRLEPEDFAVYYCQHFVNSKFTFGPGTKVEIKR

SEQ ID NO: 1107 - DNA, 21 bp, Artificial Sequence
  synthetic
cagcgtgttagcagcagccac

SEQ ID NO: 1108 - protein, 7 aa, Artificial Sequence
  synthetic
QRVSSSH

SEQ ID NO: 1109 - DNA, 9 bp, Artificial Sequence
  synthetic
ggtgcatcc

SEQ ID NO: 1110 - protein, 3 aa, Artificial Sequence
  synthetic
GAS

SEQ ID NO: 1111 - DNA, 27 bp, Artificial Sequence
  synthetic
cagcattttgttaactcaaaattcact

SEQ ID NO: 1112 - protein, 9 aa, Artificial Sequence
  synthetic
QHFVNSKFT

SEQ ID NO: 1113 - DNA, 366 bp, Artificial Sequence
  synthetic
caggtgcagctggtggagtcgggcccaggactggtgaagccttcggagaccctgtccctcacctgcactgtctctggtggctccatcagcacttactattggagctggatacggcagcccccagggaagggactggagtggattgggtatatctattacagtgggaggaccaactacaatccctccctcaagagtcgagtcatcatatcagtagacacgtccaagaaccagttctccctgaagctgagttctgtgaccgctgcagacacggccgtgtattactgtgcgcgagatcttcatatagcagtgggtggctactggttcttcgatttctggggccgtggcaccctggtcaccgtctcctca

SEQ ID NO: 1114 - protein, 122 aa, Artificial Sequence
  synthetic
QVQLVESGPGLVKPSETLSLTCTVSGGSISTYYWSWIRQPPGKGLEWIGYIYYSGRTNYNPSLKSRVIISVDTSKNQFSLKLSSVTAADTAVYYCARDLHIAVGGYWFFDFWGRGTLVTVSS

SEQ ID NO: 1115 - DNA, 24 bp, Artificial Sequence
  synthetic
ggtggctccatcagcacttactat

SEQ ID NO: 1116 - protein, 8 aa, Artificial Sequence
  synthetic
GGSISTYY

SEQ ID NO: 1117 - DNA, 21 bp, Artificial Sequence
  synthetic
atctattacagtgggaggacc

SEQ ID NO: 1118 - protein, 7 aa, Artificial Sequence
  synthetic
IYYSGRT

SEQ ID NO: 1119 - DNA, 48 bp, Artificial Sequence
  synthetic
gcgcgagatcttcatatagcagtgggtggctactggttcttcgatttc

SEQ ID NO: 1120 - protein, 16 aa, Artificial Sequence
  synthetic
ARDLHIAVGGYWFFDF

SEQ ID NO: 1121 - DNA, 324 bp, Artificial Sequence
  synthetic
gacatccagatgacccagtctccatcctccctgtctgcatctgtaggagacagagtcaccatcacttgccggacaagtcagagcattaacaactatttgaattggtatcagcagaaaccagggaaggcccctaacctcctgatctatgctgcatccactttacaaactggggtcccatcacggttcagtggcagtggatctgggacaactttcactctcaccatcaacagtctgcaacctgaagattttgcaacttacttctgtcagcaaatttacagtctcccgatcaccttcggccaggggacacgactggagattaaacga

SEQ ID NO: 1122 - protein, 108 aa, Artificial Sequence
  synthetic
DIQMTQSPSSLSASVGDRVTITCRTSQSINNYLNWYQQKPGKAPNLLIYAASTLQTGVPSRFSGSGSGTTFTLTINSLQPEDFATYFCQQIYSLPITFGQGTRLEIKR

SEQ ID NO: 1123 - DNA, 18 bp, Artificial Sequence
  synthetic
cagagcattaacaactat

SEQ ID NO: 1124 - protein, 6 aa, Artificial Sequence
  synthetic
QSINNY

SEQ ID NO: 1125 - DNA, 9 bp, Artificial Sequence
  synthetic
gctgcatcc

SEQ ID NO: 1126 - protein, 3 aa, Artificial Sequence
  synthetic
AAS

SEQ ID NO: 1127 - DNA, 27 bp, Artificial Sequence
  synthetic
cagcaaatttacagtctcccgatcacc

SEQ ID NO: 1128 - protein, 9 aa, Artificial Sequence
  synthetic
QQIYSLPIT

SEQ ID NO: 1129 - DNA, 369 bp, Artificial Sequence
  synthetic
caggtgcagctggtggagtctgggggaggcttggttcagccagggcggtccctgagactctcctgttcagctgctggattcacctttggtgattttgctatgagctgggtccgccaggctccagggaaggggctggagtgggtaggtttcattagaagcaacacttatggtgggacaacagaatacgccgtgtctgtgagaggcagattcaccatctcaagagatgattccaaaaatatcgcctatctgcaaatgaatagcctgaaaaccgaggacacagccgtgtattactgtactagagagggcagggactacggtgactacgttcttgactactggggccagggaaccctggtcaccgtctcctca

SEQ ID NO: 1130 - protein, 123 aa, Artificial Sequence
  synthetic
QVQLVESGGGLVQPGRSLRLSCSAAGFTFGDFAMSWVRQAPGKGLEWVGFIRSNTYGGTTEYAVSVRGRFTISRDDSKNIAYLQMNSLKTEDTAVYYCTREGRDYGDYVLDYWGQGTLVTVSS

SEQ ID NO: 1131 - DNA, 24 bp, Artificial Sequence
  synthetic
ggattcacctttggtgattttgct

SEQ ID NO: 1132 - protein, 8 aa, Artificial Sequence
  synthetic
GFTFGDFA

SEQ ID NO: 1133 - DNA, 30 bp, Artificial Sequence; identical to SEQ ID NO: 989
  synthetic

SEQ ID NO: 1134 - protein, 10 aa, Artificial Sequence
  synthetic
IRSNTYGGTT

SEQ ID NO: 1135 - DNA, 42 bp, Artificial Sequence; identical to SEQ ID NO: 991
  synthetic

SEQ ID NO: 1136 - protein, 14 aa, Artificial Sequence
  synthetic
TREGRDYGDYVLDY

SEQ ID NO: 1137 - DNA, 324 bp, Artificial Sequence
  synthetic
gacatcctgatgacccagtctccatcctccctgtttgcatctgtaggagacagagtcaccatcacttgccgggcaagtcaggacattagaaatgatttaggctggtatcagcagaaaccagggaaagcccctaaactcctgatctatcttgcatccagtttgcaaagtggggtcccatcaaggttcagcggcagtggatttggcacagatttcactctcaccatcagcagcctgcagcctgaagattttgcaatttattactgtctacaagatttcacttacccgtggacgttcggccaagggaccaaggtggagatcaaacga

SEQ ID NO: 1138 - protein, 108 aa, Artificial Sequence
  synthetic
DILMTQSPSSLFASVGDRVTITCRASQDIRNDLGWYQQKPGKAPKLLIYLASSLQSGVPSRFSGSGFGTDFTLTISSLQPEDFAIYYCLQDFTYPWTFGQGTKVEIKR

SEQ ID NO: 1139 - DNA, 18 bp, Artificial Sequence
  synthetic
caggacattagaaatgat

SEQ ID NO: 1140 - protein, 6 aa, Artificial Sequence
  synthetic
QDIRND

SEQ ID NO: 1141 - DNA, 9 bp, Artificial Sequence
  synthetic
cttgcatcc

SEQ ID NO: 1142 - protein, 3 aa, Artificial Sequence
  synthetic
LAS

SEQ ID NO: 1143 - DNA, 27 bp, Artificial Sequence
  synthetic
ctacaagatttcacttacccgtggacg

SEQ ID NO: 1144 - protein, 9 aa, Artificial Sequence
  synthetic
LQDFTYPWT

SEQ ID NO: 1145 - DNA, 369 bp, Artificial Sequence
  synthetic
caggtgcagctggtgcagtcaggtccagaactggtgaggccctcgcagaccctctcactcacctgtgccatctccggggacagtgtctctaccaacagtggtgcttggaactggatcaggcagtccccatcgagaggccttgagtggctgggaaggacatattataggtccaagtggtatgaagaatatgcagtatctgtgagaggtcgaataaccatcagcccagacacatccaagaaccagttctccctgcagatgaactctgtgactcccgaggacacggctgtgtatttctgtgcaagagaacgcagctggttctctgacgcttttgatctttggggccaagggacaatggtcaccgtctcttca

SEQ ID NO: 1146 - protein, 123 aa, Artificial Sequence
  synthetic
QVQLVQSGPELVRPSQTLSLTCAISGDSVSTNSGAWNWIRQSPSRGLEWLGRTYYRSKWYEEYAVSVRGRITISPDTSKNQFSLQMNSVTPEDTAVYFCARERSWFSDAFDLWGQGTMVTVSS

SEQ ID NO: 1147 - DNA, 30 bp, Artificial Sequence; identical to SEQ ID NO: 1035
  synthetic

SEQ ID NO: 1148 - protein, 10 aa, Artificial Sequence
  synthetic
GDSVSTNSGA

SEQ ID NO: 1149 - DNA, 27 bp, Artificial Sequence
  synthetic
acatattataggtccaagtggtatgaa

SEQ ID NO: 1150 - protein, 9 aa, Artificial Sequence
  synthetic
TYYRSKWYE

SEQ ID NO: 1151 - DNA, 39 bp, Artificial Sequence
  synthetic
gcaagagaacgcagctggttctctgacgcttttgatctt

SEQ ID NO: 1152 - protein, 13 aa, Artificial Sequence
  synthetic
ARERSWFSDAFDL

SEQ ID NO: 1153 - DNA, 321 bp, Artificial Sequence
  synthetic
gacatccagatgacccagtctccttccaccctgtctgcatctgtaggagacagagtcaccatcacttgccgggccagtcagagtattagtagctggttggcctggtatcagcagaaaccaggaaaagcccctaaactcctgatctatgaggcgtctagtttagaaagtggggtcccatcaaggttcagcggcagtagatctgggacagacttcactctcactatcagcagcctgcagcctgatgattttgcaacttattactgccaacagtataatacttattggacgttcggccaagggaccaaggtggagatcaaacga

SEQ ID NO: 1154 - protein, 107 aa, Artificial Sequence
  synthetic
DIQMTQSPSTLSASVGDRVTITCRASQSISSWLAWYQQKPGKAPKLLIYEASSLESGVPSRFSGSRSGTDFTLTISSLQPDDFATYYCQQYNTYWTFGQGTKVEIKR

SEQ ID NO: 1155 - DNA, 18 bp, Artificial Sequence
  synthetic
cagagtattagtagctgg

SEQ ID NO: 1156 - protein, 6 aa, Artificial Sequence
  synthetic
QSISSW

SEQ ID NO: 1157 - DNA, 9 bp, Artificial Sequence
  synthetic
gaggcgtct

SEQ ID NO: 1158 - protein, 3 aa, Artificial Sequence
  synthetic
EAS

SEQ ID NO: 1159 - DNA, 24 bp, Artificial Sequence
  synthetic
caacagtataatacttattggacg

SEQ ID NO: 1160 - protein, 8 aa, Artificial Sequence
  synthetic
QQYNTYWT

SEQ ID NO: 1161 - DNA, 366 bp, Artificial Sequence
  synthetic
gaggtgcagctggtggagtccgggggaggcttgggacagcctggcaggtccctgagactctcctgtgcagcctctggattcacctttgatgattatgccatgcactgggtccggcaagttccagggaagggcctggagtgggtctcaggtattagttggaatagtgataccctaggctatgcggactctgtgaagggccgattcaccatctccagagacaacgccaagaactccctttatctgcaaatgaacagtctgagacctgaggacacggccatatattactgtgcaaaggatacattagtaccagatgattgggggtatttcgctctctggggccgtggcaccctggtcaccgtctcctca

SEQ ID NO: 1162 - protein, 122 aa, Artificial Sequence
  synthetic
EVQLVESGGGLGQPGRSLRLSCAASGFTFDDYAMHWVRQVPGKGLEWVSGISWNSDTLGYADSVKGRFTISRDNAKNSLYLQMNSLRPEDTAIYYCAKDTLVPDDWGYFALWGRGTLVTVSS

SEQ ID NO: 1163 - DNA, 24 bp, Artificial Sequence
  synthetic
ggattcacctttgatgattatgcc

SEQ ID NO: 1164 - protein, 8 aa, Artificial Sequence
  synthetic
GFTFDDYA

SEQ ID NO: 1165 - DNA, 24 bp, Artificial Sequence
  synthetic
attagttggaatagtgatacccta

SEQ ID NO: 1166 - protein, 8 aa, Artificial Sequence
  synthetic
ISWNSDTL

SEQ ID NO: 1167 - DNA, 45 bp, Artificial Sequence
  synthetic
gcaaaggatacattagtaccagatgattgggggtatttcgctctc

SEQ ID NO: 1168 - protein, 15 aa, Artificial Sequence
  synthetic
AKDTLVPDDWGYFAL

SEQ ID NO: 1169 - DNA, 327 bp, Artificial Sequence
  synthetic
gacatcgtgatgacccagtctccaggcaccctgtctttgtctccaggggaaagagccaccctctcctgcagggccagtcagagtgttagtagcaactacttaacctggtaccagcagagacctggccaggctcccaggctcctcatctatggtgcatccaccagggccactggcatcccagacaggttcagtggcagtgggtctgggacagacttcactctcaccatcagcagactggagcctgaagattttgcagtgttttactgtcagcactatggttactcaaaattcactttcggccctgggaccaaggtggagatcaaacga

SEQ ID NO: 1170 - protein, 109 aa, Artificial Sequence
  synthetic
DIVMTQSPGTLSLSPGERATLSCRASQSVSSNYLTWYQQRPGQAPRLLIYGASTRATGIPDRFSGSGSGTDFTLTISRLEPEDFAVFYCQHYGYSKFTFGPGTKVEIKR

SEQ ID NO: 1171 - DNA, 21 bp, Artificial Sequence
  synthetic
cagagtgttagtagcaactac

SEQ ID NO: 1172 - protein, 7 aa, Artificial Sequence
  synthetic
QSVSSNY

SEQ ID NO: 1173 - DNA, 9 bp, Artificial Sequence
  synthetic
ggtgcatcc

SEQ ID NO: 1174 - protein, 3 aa, Artificial Sequence
  synthetic
GAS

SEQ ID NO: 1175 - DNA, 27 bp, Artificial Sequence
  synthetic
cagcactatggttactcaaaattcact

SEQ ID NO: 1176 - protein, 9 aa, Artificial Sequence
  synthetic
QHYGYSKFT

SEQ ID NO: 1177 - DNA, 354 bp, Artificial Sequence
  synthetic
caggtgcagctggtggagtctgggggaggcttggtacagcctggggggtccctgagactctcctgtacagcctctggattcacctttagcacctctgccatgagctgggtccgccaggctccagggaaggggctggagtgggtctcagctattagtagtagtggtggtagcacatactacgcagactccgtgaggggccgtttcaccatctccagagacaattccaagaacacgctgtatctgcaaatgaacagcctgagagccgaggacacggccgtttattactgtgcggagggcagtggctggtactactttgactactggggccagggaaccctggtcaccgtctcctca

SEQ ID NO: 1178 - protein, 118 aa, Artificial Sequence
  synthetic
QVQLVESGGGLVQPGGSLRLSCTASGFTFSTSAMSWVRQAPGKGLEWVSAISSSGGSTYYADSVRGRFTISRDNSKNTLYLQMNSLRAEDTAVYYCAEGSGWYYFDYWGQGTLVTVSS

SEQ ID NO: 1179 - DNA, 24 bp, Artificial Sequence
  synthetic
ggattcacctttagcacctctgcc

SEQ ID NO: 1180 - protein, 8 aa, Artificial Sequence
  synthetic
GFTFSTSA

SEQ ID NO: 1181 - DNA, 24 bp, Artificial Sequence
  synthetic
attagtagtagtggtggtagcaca

SEQ ID NO: 1182 - protein, 8 aa, Artificial Sequence
  synthetic
ISSSGGST

SEQ ID NO: 1183 - DNA, 33 bp, Artificial Sequence
  synthetic
gcggagggcagtggctggtactactttgactac

SEQ ID NO: 1184 - protein, 11 aa, Artificial Sequence
  synthetic
AEGSGWYYFDY

SEQ ID NO: 1185 - DNA, 327 bp, Artificial Sequence
  synthetic
gaaatcgtgatgacccagtctccaggcaccatgtctttgtctccaggggaaagagccaccctctcctgcagggccagtcagagtgttagcagcaactacttagcctggtaccagcagaaacctggccaggctcccaggctcctcatctatggtgcatccagcagggccactggcatcccagacaggttcagtggcagtgggtctgggacagacttcactctcaccatcagcagactggaacctgaagattttgcagtgtatttctgtcagcaatatggtagctcaccgctcactttcggcggagggaccaaggtggagatcaaacga

SEQ ID NO: 1186 - protein, 109 aa, Artificial Sequence
  synthetic
EIVMTQSPGTMSLSPGERATLSCRASQSVSSNYLAWYQQKPGQAPRLLIYGASSRATGIPDRFSGSGSGTDFTLTISRLEPEDFAVYFCQQYGSSPLTFGGGTKVEIKR

SEQ ID NO: 1187 - DNA, 21 bp, Artificial Sequence
  synthetic
cagagtgttagcagcaactac

SEQ ID NO: 1188 - protein, 7 aa, Artificial Sequence
  synthetic
QSVSSNY

SEQ ID NO: 1189 - DNA, 9 bp, Artificial Sequence
  synthetic
ggtgcatcc

SEQ ID NO: 1190 - protein, 3 aa, Artificial Sequence
  synthetic
GAS

SEQ ID NO: 1191 - DNA, 27 bp, Artificial Sequence
  synthetic
cagcaatatggtagctcaccgctcact

SEQ ID NO: 1192 - protein, 9 aa, Artificial Sequence
  synthetic
QQYGSSPLT

SEQ ID NO: 1193 - DNA, 366 bp, Artificial Sequence
  synthetic
gaggtgcagctggtggagtctgggggaggcgtggtacagccgggggggtccctgagactctcctgtaaaacctctggattcatctttgatgattatgccatgcactgggtccggcaagctccagggaagggcctggagtgggtctcaggcattaattggaatagtggaaccatagactattcagactctgtgaagggccgattcaccatctccagagacaacgccaagaaatccctgtatctccaaatgaacagtctgagatctgaggacacggccttgtattattgtataaaagatatattagtgccagatgcatgggggcatttcgatatttggggccgtggcaccctggtcaccgtctcctca

SEQ ID NO: 1194 - protein, 122 aa, Artificial Sequence
  synthetic
EVQLVESGGGVVQPGGSLRLSCKTSGFIFDDYAMHWVRQAPGKGLEWVSGINWNSGTIDYSDSVKGRFTISRDNAKKSLYLQMNSLRSEDTALYYCIKDILVPDAWGHFDIWGRGTLVTVSS

SEQ ID NO: 1195 - DNA, 24 bp, Artificial Sequence
  synthetic
ggattcatctttgatgattatgcc

SEQ ID NO: 1196 - protein, 8 aa, Artificial Sequence
  synthetic
GFIFDDYA

SEQ ID NO: 1197 - DNA, 24 bp, Artificial Sequence
  synthetic
attaattggaatagtggaaccata

SEQ ID NO: 1198 - protein, 8 aa, Artificial Sequence
  synthetic
INWNSGTI

SEQ ID NO: 1199 - DNA, 45 bp, Artificial Sequence
  synthetic
ataaaagatatattagtgccagatgcatgggggcatttcgatatt

SEQ ID NO: 1200 - protein, 15 aa, Artificial Sequence
  synthetic
IKDILVPDAWGHFDI

SEQ ID NO: 1201 - DNA, 327 bp, Artificial Sequence; identical to SEQ ID NO: 977
  synthetic

SEQ ID NO: 1202 - protein, 109 aa, Artificial Sequence; identical to SEQ ID NO: 978
  synthetic

SEQ ID NO: 1203 - DNA, 21 bp, Artificial Sequence
  synthetic
cagagtgttagcagcacctac

SEQ ID NO: 1204 - protein, 7 aa, Artificial Sequence
  synthetic
QSVSSTY

SEQ ID NO: 1205 - DNA, 9 bp, Artificial Sequence
  synthetic
ggtgcatcc

SEQ ID NO: 1206 - protein, 3 aa, Artificial Sequence
  synthetic
GAS

SEQ ID NO: 1207 - DNA, 27 bp, Artificial Sequence
  synthetic
caacattatggttactcaaaattcact

SEQ ID NO: 1208 - protein, 9 aa, Artificial Sequence
  synthetic
QHYGYSKFT

SEQ ID NO: 1209 - DNA, 366 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagcgccagggaagggcctggagtgggtctcaggtattagttggaatagtgataatgtagactatgcggactctgtgaagggccgattcaccatctccagagacaacgccaagaactccctgtatctgcaaatgaacagtctgagatctgaggacacggccctgtattactgtacaaaagatatactagtaccggattcatgggggtggttcgatctctggggccgtggcaccctggtcaccgtctcctca

SEQ ID NO: 1210 - protein, 122 aa, Artificial Sequence
  synthetic
EVQLVESGGGLVQPGRSLRLSCAASGFTFDDYAMHWVRQAPGKGLEWVSGISWNSDNVDYADSVKGRFTISRDNAKNSLYLQMNSLRSEDTALYYCTKDILVPDSWGWFDLWGRGTLVTVSS

SEQ ID NO: 1211 - DNA, 24 bp, Artificial Sequence
  synthetic
ggattcacctttgatgattatgcc

SEQ ID NO: 1212 - protein, 8 aa, Artificial Sequence
  synthetic
GFTFDDYA

SEQ ID NO: 1213 - DNA, 24 bp, Artificial Sequence
  synthetic
attagttggaatagtgataatgta

SEQ ID NO: 1214 - protein, 8 aa, Artificial Sequence
  synthetic
ISWNSDNV

SEQ ID NO: 1215 - DNA, 45 bp, Artificial Sequence
  synthetic
acaaaagatatactagtaccggattcatgggggtggttcgatctc

SEQ ID NO: 1216 - protein, 15 aa, Artificial Sequence
  synthetic
TKDILVPDSWGWFDL

SEQ ID NO: 1217 - DNA, 327 bp, Artificial Sequence
  synthetic
gacatcctgatgacccagtctccatcctccctgtctgcatctgtaggagacagagtcaccatcacttgccgggcaagtctgagcattagcaactatttaaattggtatcagcagaaaccagggaaagcccctaagctcctgatctatgctgcatccagtttgcaaagtggggtcccatcaaggttcagtggcagtggctctgggacagatttcactctcaccatcagcagtctgcaacctgaagattttgcaacttactactgtcaacagagttacagtgtccctccgatcaccttcggccaggggaccaaactggagatcaaacga

SEQ ID NO: 1218 - protein, 109 aa, Artificial Sequence
  synthetic
DILMTQSPSSLSASVGDRVTITCRASLSISNYLNWYQQKPGKAPKLLIYAASSLQSGVPSRFSGSGSGTDFTLTISSLQPEDFATYYCQQSYSVPPITFGQGTKLEIKR

SEQ ID NO: 1219 - DNA, 18 bp, Artificial Sequence
  synthetic
ctgagcattagcaactat

SEQ ID NO: 1220 - protein, 6 aa, Artificial Sequence
  synthetic
LSISNY

SEQ ID NO: 1221 - DNA, 9 bp, Artificial Sequence
  synthetic
gctgcatcc

SEQ ID NO: 1222 - protein, 3 aa, Artificial Sequence
  synthetic
AAS

SEQ ID NO: 1223 - DNA, 30 bp, Artificial Sequence
  synthetic
caacagagttacagtgtccctccgatcacc

SEQ ID NO: 1224 - protein, 10 aa, Artificial Sequence
  synthetic
QQSYSVPPIT

SEQ ID NO: 1225 - DNA, 366 bp, Artificial Sequence
  synthetic
gaggtgcagctggtggagtctgggggaggcttggtacagcctggcaggtccctgagactctcctgtgcagcctctggattcacctttgatgattatgccatgcactgggttaggcaagcgccagggaagggcctagagtgggtctcaggtattagttggaatagtgatgatgtagactatgcggactctgtgaagggccgattcaccatctccagagacaacgccaagaactccctgtatctgcaaatgaacagtctgagatctgaggacacggccctgtattactgtgcaaaagatatattattaccagatgcatgggggtggttcgatctctggggccgtggcaccccggtcaccgtctcctca

SEQ ID NO: 1226 - protein, 122 aa, Artificial Sequence
  synthetic
EVQLVESGGGLVQPGRSLRLSCAASGFTFDDYAMHWVRQAPGKGLEWVSGISWNSDDVDYADSVKGRFTISRDNAKNSLYLQMNSLRSEDTALYYCAKDILLPDAWGWFDLWGRGTPVTVSS

SEQ ID NO: 1227 - DNA, 24 bp, Artificial Sequence
  synthetic
ggattcacctttgatgattatgcc

SEQ ID NO: 1228 - protein, 8 aa, Artificial Sequence
  synthetic
GFTFDDYA

SEQ ID NO: 1229 - DNA, 24 bp, Artificial Sequence
  synthetic
attagttggaatagtgatgatgta

SEQ ID NO: 1230 - protein, 8 aa, Artificial Sequence
  synthetic
ISWNSDDV

SEQ ID NO: 1231 - DNA, 45 bp, Artificial Sequence
  synthetic
gcaaaagatatattattaccagatgcatgggggtggttcgatctc

SEQ ID NO: 1232 - protein, 15 aa, Artificial Sequence
  synthetic
AKDILLPDAWGWFDL

SEQ ID NO: 1233 - DNA, 327 bp, Artificial Sequence
  synthetic
gacatcgtgatgacccagtctccagacaccctgtctttgtctccaggggaaagagccaccctctcctgcagggccagtcagcgtgttagcatcagctacttaacctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtatattactgtcagcattttgttaactcaaaattcattttcggccctgggaccaaggtggagatcaaacga

SEQ ID NO: 1234 - protein, 109 aa, Artificial Sequence
  synthetic
DIVMTQSPDTLSLSPGERATLSCRASQRVSISYLTWYQQKPGQAPRLLIYGASSRATGIPDRFSGSGSGTDFTLTISRLEPEDFAVYYCQHFVNSKFIFGPGTKVEIKR

SEQ ID NO: 1235 - DNA, 21 bp, Artificial Sequence
  synthetic
cagcgtgttagcatcagctac

SEQ ID NO: 1236 - protein, 7 aa, Artificial Sequence
  synthetic
QRVSISY

SEQ ID NO: 1237 - DNA, 9 bp, Artificial Sequence
  synthetic
ggtgcatcc

SEQ ID NO: 1238 - protein, 3 aa, Artificial Sequence
  synthetic
GAS

SEQ ID NO: 1239 - DNA, 27 bp, Artificial Sequence
  synthetic
cagcattttgttaactcaaaattcatt

SEQ ID NO: 1240 - protein, 9 aa, Artificial Sequence
  synthetic
QHFVNSKFI

SEQ ID NO: 1241 - DNA, 366 bp, Artificial Sequence
  synthetic
caggtgcagctggtggagtctgggggaggcttggtacagcctggcaggtccctgagactctcctgtgcagcctctggattcacctttgatgattatgccatgcactgggtccggcaagcgccagggaagggcctggagtgggtctcaggtattagttggaatagtgataatgtagactatgcggactctgtgaagggccgattcaccatctccagagacaacgccaagaactccctgtatctgcaaatgaacagtctgagatctgaggacacggccctgtattactgtacaaaagatatactagtaccggattcatgggggtggttcgatctctggggccgtggcaccctggtcaccgtctcctca

SEQ ID NO: 1242 - protein, 122 aa, Artificial Sequence
  synthetic
QVQLVESGGGLVQPGRSLRLSCAASGFTFDDYAMHWVRQAPGKGLEWVSGISWNSDNVDYADSVKGRFTISRDNAKNSLYLQMNSLRSEDTALYYCTKDILVPDSWGWFDLWGRGTLVTVSS

SEQ ID NO: 1243 - DNA, 24 bp, Artificial Sequence
  synthetic
ggattcacctttgatgattatgcc

SEQ ID NO: 1244 - protein, 8 aa, Artificial Sequence
  synthetic
GFTFDDYA

SEQ ID NO: 1245 - DNA, 24 bp, Artificial Sequence
  synthetic
attagttggaatagtgataatgta

SEQ ID NO: 1246 - protein, 8 aa, Artificial Sequence
  synthetic
ISWNSDNV

SEQ ID NO: 1247 - DNA, 45 bp, Artificial Sequence; identical to SEQ ID NO: 1215
  synthetic

SEQ ID NO: 1248 - protein, 15 aa, Artificial Sequence
  synthetic
TKDILVPDSWGWFDL

SEQ ID NO: 1249 - DNA, 327 bp, Artificial Sequence
  synthetic
gacatcgtgatgacccagtctccagacaccctgtctttgtctccaggggaaagagccaccctctcctgcagggccagtcagcgtgttagcagcagccacttaacctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcactatattactgtcaacattttgttaactcaaaattcactttcggccctgggaccaaggtggagatcaaacga

SEQ ID NO: 1250 - protein, 109 aa, Artificial Sequence
  synthetic
DIVMTQSPDTLSLSPGERATLSCRASQRVSSSHLTWYQQKPGQAPRLLIYGASSRATGIPDRFSGSGSGTDFTLTISRLEPEDFALYYCQHFVNSKFTFGPGTKVEIKR

SEQ ID NO: 1251 - DNA, 21 bp, Artificial Sequence
  synthetic
cagcgtgttagcagcagccac

SEQ ID NO: 1252 - protein, 7 aa, Artificial Sequence
  synthetic
QRVSSSH

SEQ ID NO: 1253 - DNA, 9 bp, Artificial Sequence
  synthetic
ggtgcatcc

SEQ ID NO: 1254 - protein, 3 aa, Artificial Sequence
  synthetic
GAS

SEQ ID NO: 1255 - DNA, 27 bp, Artificial Sequence
  synthetic
caacattttgttaactcaaaattcact

SEQ ID NO: 1256 - protein, 9 aa, Artificial Sequence
  synthetic
QHFVNSKFT

SEQ ID NO: 1257 - DNA, 357 bp, Artificial Sequence
  synthetic
gaggtgcagctggtggagtctgggggaggcttggtacagcctggggggtccctgagagtctcctgtgcagcctctggattcacctttagcagctatgccatgagctgggtccgccaggctccagggagggggctggagtgggtctcaggtattagtggtggtagcggtagtacatactacgcagactccgtgaagggccgattcaccatctccagagacaattccaagaacacgctgtatctgcaaatgaacagcctgagaggcgaggacacggccgtatattactgtgcgaggtggcaacgattagaggactggttcgacccctggggccagggaaccctggtcaccgtctcctca

SEQ ID NO: 1258 - protein, 119 aa, Artificial Sequence
  synthetic
EVQLVESGGGLVQPGGSLRVSCAASGFTFSSYAMSWVRQAPGRGLEWVSGISGGSGSTYYADSVKGRFTISRDNSKNTLYLQMNSLRGEDTAVYYCARWQRLEDWFDPWGQGTLVTVSS

SEQ ID NO: 1259 - DNA, 24 bp, Artificial Sequence
  synthetic
ggattcacctttagcagctatgcc

SEQ ID NO: 1260 - protein, 8 aa, Artificial Sequence
  synthetic
GFTFSSYA

SEQ ID NO: 1261 - DNA, 24 bp, Artificial Sequence
  synthetic
attagtggtggtagcggtagtaca

SEQ ID NO: 1262 - protein, 8 aa, Artificial Sequence
  synthetic
ISGGSGST

SEQ ID NO: 1263 - DNA, 36 bp, Artificial Sequence
  synthetic
gcgaggtggcaacgattagaggactggttcgacccc

SEQ ID NO: 1264 - protein, 12 aa, Artificial Sequence
  synthetic
ARWQRLEDWFDP

SEQ ID NO: 1265 - DNA, 324 bp, Artificial Sequence
  synthetic
gacatcctgatgacccagtctccatcctccctgtctgcatctgtgggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaacattttgcaacttacttttgtcaacagagttacagtaccccgtacacttttggccaggggaccaaggtggagatcaaacga

SEQ ID NO: 1266 - protein, 108 aa, Artificial Sequence
  synthetic
DILMTQSPSSLSASVGDRVTITCRASQSISSYLNWYQQKPGKAPKLLIYAASSLQSGVPSRFSGSGSGTDFTLTISSLQPEHFATYFCQQSYSTPYTFGQGTKVEIKR

SEQ ID NO: 1267 - DNA, 18 bp, Artificial Sequence
  synthetic
cagagcattagcagctat

SEQ ID NO: 1268 - protein, 6 aa, Artificial Sequence
  synthetic
QSISSY

SEQ ID NO: 1269 - DNA, 9 bp, Artificial Sequence
  synthetic
gctgcatcc

SEQ ID NO: 1270 - protein, 3 aa, Artificial Sequence
  synthetic
AAS

SEQ ID NO: 1271 - DNA, 27 bp, Artificial Sequence
  synthetic
caacagagttacagtaccccgtacact

SEQ ID NO: 1272 - protein, 9 aa, Artificial Sequence
  synthetic
QQSYSTPYT

SEQ ID NO: 1273 - DNA, 372 bp, Artificial Sequence
  synthetic
caggtgcagctggtggagtctggtcctgcgctggtgagacccacacagaccctcacactgacctgcaccttctctgggttctcactcaccactagtggaatgtgtgtgacctggatccgtcagcccccagggaagaccctggagtggcttgcacgcattgattgggatgatgataaatactacaacacatctctgaagaccaggctcaccatctccaaggacacctccaaaaaccaggttgtccttacaatgaccaacatggaccctgtggacacagccacgtattactgtgcacggatccacggtgactacgcccactactactacggtttggacgtctggggccaagggaccacggtcaccgtctcctca

SEQ ID NO: 1274 - protein, 124 aa, Artificial Sequence
  synthetic
QVQLVESGPALVRPTQTLTLTCTFSGFSLTTSGMCVTWIRQPPGKTLEWLARIDWDDDKYYNTSLKTRLTISKDTSKNQVVLTMTNMDPVDTATYYCARIHGDYAHYYYGLDVWGQGTTVTVSS

SEQ ID NO: 1275 - DNA, 30 bp, Artificial Sequence
  synthetic
gggttctcactcaccactagtggaatgtgt

SEQ ID NO: 1276 - protein, 10 aa, Artificial Sequence
  synthetic
GFSLTTSGMC

SEQ ID NO: 1277 - DNA, 21 bp, Artificial Sequence
  synthetic
attgattgggatgatgataaa

SEQ ID NO: 1278 - protein, 7 aa, Artificial Sequence
  synthetic
IDWDDDK

SEQ ID NO: 1279 - DNA, 48 bp, Artificial Sequence
  synthetic
gcacggatccacggtgactacgcccactactactacggtttggacgtc

SEQ ID NO: 1280 - protein, 16 aa, Artificial Sequence
  synthetic
ARIHGDYAHYYYGLDV

SEQ ID NO: 1281 - DNA, 324 bp, Artificial Sequence
  synthetic
gacatcctgatgacccagtctccatcctcactgtctgcatctgtaggagacagagtcaccatcacttgtcgggcgagtcagggcattagcaattatttagcctggtttcagcagaaaccagggaaagcccctaagtccctaatctatgctgcatccagtttgcaaagtggggtcccatcaaaattcagcggcagtggatctgggacagatttcactctcaccatcagcagcctgcagcctgaagattttgcaacttattactgccaacaatataatagttacccgtacacttttggccaggggaccaaggtggagatcaaacga

SEQ ID NO: 1282 - protein, 108 aa, Artificial Sequence
  synthetic
DILMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKVEIKR

SEQ ID NO: 1283 - DNA, 18 bp, Artificial Sequence
  synthetic
cagggcattagcaattat

SEQ ID NO: 1284 - protein, 6 aa, Artificial Sequence
  synthetic
QGISNY

SEQ ID NO: 1285 - DNA, 9 bp, Artificial Sequence
  synthetic
gctgcatcc

SEQ ID NO: 1286 - protein, 3 aa, Artificial Sequence
  synthetic
AAS

SEQ ID NO: 1287 - DNA, 27 bp, Artificial Sequence
  synthetic
caacaatataatagttacccgtacact

SEQ ID NO: 1288 - protein, 9 aa, Artificial Sequence
  synthetic
QQYNSYPYT

SEQ ID NO: 1289 - DNA, 372 bp, Artificial Sequence
  synthetic
caggtgcagctggtggagtctgggggaggcttggtacagcctggggggtccctgagactctcctgtgcagcctctggattcacctttagcacctatgccatgaactgggtccgccaggctccagggaaggggctggagtgggtctcaggtattagtggtagtggtggtagttcatattacgcagactccgtgaagggccgcttcaccatctccagagacaattccaagagcacgctgtatctgcaaatgaacagcctgagagccgaggacacggccgtatattactgtacgaaagccggggagcagttcgccctctactactactacggtatggacgtctggggccaagggaccacggtcaccgtctcctca

SEQ ID NO: 1290 - protein, 124 aa, Artificial Sequence
  synthetic
QVQLVESGGGLVQPGGSLRLSCAASGFTFSTYAMNWVRQAPGKGLEWVSGISGSGGSSYYADSVKGRFTISRDNSKSTLYLQMNSLRAEDTAVYYCTKAGEQFALYYYYGMDVWGQGTTVTVSS

SEQ ID NO: 1291 - DNA, 24 bp, Artificial Sequence
  synthetic
ggattcacctttagcacctatgcc

SEQ ID NO: 1292 - protein, 8 aa, Artificial Sequence
  synthetic
GFTFSTYA

SEQ ID NO: 1293 - DNA, 24 bp, Artificial Sequence
  synthetic
attagtggtagtggtggtagttca

SEQ ID NO: 1294 - protein, 8 aa, Artificial Sequence
  synthetic
ISGSGGSS

SEQ ID NO: 1295 - DNA, 51 bp, Artificial Sequence
  synthetic
acgaaagccggggagcagttcgccctctactactactacggtatggacgtc

SEQ ID NO: 1296 - protein, 17 aa, Artificial Sequence
  synthetic
TKAGEQFALYYYYGMDV

SEQ ID NO: 1297 - DNA, 324 bp, Artificial Sequence
  synthetic
gacatccagatgacccagtctccatccttcctgtctgcctctgtaggagacagagtcaccatcacttgctgggccagtcaggacattagcagttttttagcctggtatcagcaaaaaccagggaaagcccctaagctcctgatctattctgcatccactttgcaaagtggggtcccatcaaggttcagcggcagtggatctgggacagaattcactctcacaatcagcagcctgcagcctgaagattttgcaacttattactgtcaacagcttaatagttatgcgctcactttcggcggagggaccaaggtggagatcaaacga

SEQ ID NO: 1298 - protein, 108 aa, Artificial Sequence
  synthetic
DIQMTQSPSFLSASVGDRVTITCWASQDISSFLAWYQQKPGKAPKLLIYSASTLQSGVPSRFSGSGSGTEFTLTISSLQPEDFATYYCQQLNSYALTFGGGTKVEIKR

SEQ ID NO: 1299 - DNA, 18 bp, Artificial Sequence
  synthetic
caggacattagcagtttt

SEQ ID NO: 1300 - protein, 6 aa, Artificial Sequence
  synthetic
QDISSF

SEQ ID NO: 1301 - DNA, 9 bp, Artificial Sequence
  synthetic
tctgcatcc

SEQ ID NO: 1302 - protein, 3 aa, Artificial Sequence
  synthetic
SAS

SEQ ID NO: 1303 - DNA, 27 bp, Artificial Sequence
  synthetic
caacagcttaatagttatgcgctcact

SEQ ID NO: 1304 - protein, 9 aa, Artificial Sequence
  synthetic
QQLNSYALT

SEQ ID NO: 1305 - DNA, 381 bp, Artificial Sequence
  synthetic
gaggtgcagctggtggagtcgggcccaggactggtgaagccttcggagaccctgtccctcacctgcactgtctctggtggctccatcaataattactactggagctggatccggcagcccccaggaaagggactggagtggattgggtatatctattacattgggagcaccaactacaacccctccctcaagagtcgagtcaccatatcagtagatacgtccaagaaccagttctccctgaagctgagctctgtgaccgctgcggacacggccgtttattactgtgcgagagaggattacgatttttggagtgcccaaggggactactactactacggtgtggacgtctggggccaagggaccacggtcaccgtctcctca

SEQ ID NO: 1306 - protein, 127 aa, Artificial Sequence
  synthetic
EVQLVESGPGLVKPSETLSLTCTVSGGSINNYYWSWIRQPPGKGLEWIGYIYYIGSTNYNPSLKSRVTISVDTSKNQFSLKLSSVTAADTAVYYCAREDYDFWSAQGDYYYYGVDVWGQGTTVTVSS

SEQ ID NO: 1307 - DNA, 24 bp, Artificial Sequence
  synthetic
ggtggctccatcaataattactac

SEQ ID NO: 1308 - protein, 8 aa, Artificial Sequence
  synthetic
GGSINNYY

SEQ ID NO: 1309 - DNA, 21 bp, Artificial Sequence
  synthetic
atctattacattgggagcacc

SEQ ID NO: 1310 - protein, 7 aa, Artificial Sequence
  synthetic
IYYIGST

SEQ ID NO: 1311 - DNA, 63 bp, Artificial Sequence
  synthetic
gcgagagaggattacgatttttggagtgcccaaggggactactactactacggtgtggacgtc

SEQ ID NO: 1312 - protein, 21 aa, Artificial Sequence
  synthetic
AREDYDFWSAQGDYYYYGVDV

SEQ ID NO: 1313 - DNA, 324 bp, Artificial Sequence
  synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaacctcctgatctatgctgcatccagtttgcaaagtggggtcccatcaaggttcagcggcagtggatctgggacagatttcactctcaccatcagcagcctgcagcctgaggattttgcaacttactattgtcaacaggctaacagtttcccgctcactttcggcggagggaccaaggtggagatcaaacga

SEQ ID NO: 1314 - protein, 108 aa, Artificial Sequence
  synthetic
DIQMTQSPSSVSASVGDRVTITCRASQGISSWLAWYQQKPGKAPNLLIYAASSLQSGVPSRFSGSGSGTDFTLTISSLQPEDFATYYCQQANSFPLTFGGGTKVEIKR

SEQ ID NO: 1315 - DNA, 18 bp, Artificial Sequence
  synthetic
cagggtattagcagctgg

SEQ ID NO: 1316 - protein, 6 aa, Artificial Sequence
  synthetic
QGISSW

SEQ ID NO: 1317 - DNA, 9 bp, Artificial Sequence
  synthetic
gctgcatcc

SEQ ID NO: 1318 - protein, 3 aa, Artificial Sequence
  synthetic
AAS

SEQ ID NO: 1319 - DNA, 27 bp, Artificial Sequence
  synthetic
caacaggctaacagtttcccgctcact

SEQ ID NO: 1320 - protein, 9 aa, Artificial Sequence
  synthetic
QQANSFPLT

SEQ ID NO: 1321 - DNA, 357 bp, Artificial Sequence
  synthetic
gaggtgcagctggtggagtctgggggaggcttggtacagccgggggggtccctgagactctcctgtgcagcctctggattcagcttcagcagctatgccatgaactgggtccgccaggctccagggaaggggctggagtgggtctcaggtattagtggtagtggtggtagcacatattacgcagactccgtgaagggccggttcaccatctccagagacaattccaagaacacgctgtatctgcaaataaacagcctgagagtcgaggacacggccgtatattactgtgcgaggtggcaacgattagaggactggttcgacccctggggccagggaaccctggtcaccgtctcctca

SEQ ID NO: 1322 - protein, 119 aa, Artificial Sequence
  synthetic
EVQLVESGGGLVQPGGSLRLSCAASGFSFSSYAMNWVRQAPGKGLEWVSGISGSGGSTYYADSVKGRFTISRDNSKNTLYLQINSLRVEDTAVYYCARWQRLEDWFDPWGQGTLVTVSS

SEQ ID NO: 1323 - DNA, 24 bp, Artificial Sequence
  synthetic
ggattcagcttcagcagctatgcc

SEQ ID NO: 1324 - protein, 8 aa, Artificial Sequence
  synthetic
GFSFSSYA

SEQ ID NO: 1325 - DNA, 24 bp, Artificial Sequence
  synthetic
attagtggtagtggtggtagcaca

SEQ ID NO: 1326 - protein, 8 aa, Artificial Sequence
  synthetic
ISGSGGST

SEQ ID NO: 1327 - DNA, 36 bp, Artificial Sequence; identical to SEQ ID NO: 1263
  synthetic

SEQ ID NO: 1328 - protein, 12 aa, Artificial Sequence
  synthetic
ARWQRLEDWFDP

SEQ ID NO: 1329 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaaactcctgatctattctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaaggtggagatcaaacga

SEQ ID NO: 1330 - protein, 108 aa, Artificial Sequence
  synthetic
DIQMTQSPSSLSASVGDRVTITCRASQSISSYLNWYQQKPGKAPKLLIYSASSLQSGVPSRFSGSGSGTDFTLTISSLQPEDFATYYCQQSYSTPYTFGQGTKVEIKR

SEQ ID NO: 1331 - DNA, 18 bp, Artificial Sequence
  synthetic
cagagcattagcagctat

SEQ ID NO: 1332 - protein, 6 aa, Artificial Sequence
  synthetic
QSISSY

SEQ ID NO: 1333 - DNA, 9 bp, Artificial Sequence
  synthetic
tctgcatcc

SEQ ID NO: 1334 - protein, 3 aa, Artificial Sequence
  synthetic
SAS

SEQ ID NO: 1335 - DNA, 27 bp, Artificial Sequence
  synthetic
caacagagttacagtaccccgtacact

SEQ ID NO: 1336 - protein, 9 aa, Artificial Sequence
  synthetic
QQSYSTPYT

SEQ ID NO: 1337 - DNA, 357 bp, Artificial Sequence
  synthetic
gaggtgcagctggtggagtctgggggaggcttggtacagcctggggggtccctgagactctcctgtgcagcctctggattcacctttagtagttatgccatgagttgggtccgccaggctccagggaaggggctggagtgggtctcaggtattagtggtggtgctggtagcacatactacgcagactccgtgaagggccggttcaccatctccagagacaattccaagaacacgctgtatctggaaatgaacagcctgagagccgaggacacggccgtatattactgtgcgaagtggcaacgattagaggactggttcgacccctggggccagggaaccatggtcaccgtctcctca

SEQ ID NO: 1338 - protein, 119 aa, Artificial Sequence
  synthetic
EVQLVESGGGLVQPGGSLRLSCAASGFTFSSYAMSWVRQAPGKGLEWVSGISGGAGSTYYADSVKGRFTISRDNSKNTLYLEMNSLRAEDTAVYYCAKWQRLEDWFDPWGQGTMVTVSS

SEQ ID NO: 1339 - DNA, 24 bp, Artificial Sequence
  synthetic
ggattcacctttagtagttatgcc

SEQ ID NO: 1340 - protein, 8 aa, Artificial Sequence
  synthetic
GFTFSSYA

SEQ ID NO: 1341 - DNA, 24 bp, Artificial Sequence
  synthetic
attagtggtggtgctggtagcaca

SEQ ID NO: 1342 - protein, 8 aa, Artificial Sequence
  synthetic
ISGGAGST

SEQ ID NO: 1343 - DNA, 36 bp, Artificial Sequence
  synthetic
gcgaagtggcaacgattagaggactggttcgacccc

SEQ ID NO: 1344 - protein, 12 aa, Artificial Sequence
  synthetic
AKWQRLEDWFDP

SEQ ID NO: 1345 - DNA, 324 bp, Artificial Sequence
  synthetic
gacatccagatgacccagtctccatcctccctgtctgcatctgtgggagacagagtcaccatcacttgccggtcaagtcagagcattaacaggtatttaaattggtatcagcagaagccagggaaagcccctaaactcctgatctatactgcatccactttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaaggtggagatcaaacga

SEQ ID NO: 1346 - protein, 108 aa, Artificial Sequence
  synthetic
DIQMTQSPSSLSASVGDRVTITCRSSQSINRYLNWYQQKPGKAPKLLIYTASTLQSGVPSRFSGSGSGTDFTLTISSLQPEDFATYYCQQSYSTPYTFGQGTKVEIKR

SEQ ID NO: 1347 - DNA, 18 bp, Artificial Sequence
  synthetic
cagagcattaacaggtat

SEQ ID NO: 1348 - protein, 6 aa, Artificial Sequence
  synthetic
QSINRY

SEQ ID NO: 1349 - DNA, 9 bp, Artificial Sequence
  synthetic
actgcatcc

SEQ ID NO: 1350 - protein, 3 aa, Artificial Sequence
  synthetic
TAS

SEQ ID NO: 1351 - DNA, 27 bp, Artificial Sequence
  synthetic
caacagagttacagtaccccgtacact

SEQ ID NO: 1352 - protein, 9 aa, Artificial Sequence
  synthetic
QQSYSTPYT

SEQ ID NO: 1353 - DNA, 384 bp, Artificial Sequence
  synthetic
caggtgcagctggtggagtctggtcctgcgctggtgaaacccacacagaccctcacactgacctgcaccttctctgggttctcactcagcactagtggaatgtgtgtgaactggatccgtcagcccccagggaaggccctggagtggcttacacgcattgattgggatgatgataagttctacagcacatctctggagaccaggctcaccatctccaaggacacctccaaaaaccaggtggtccttacaatgaccaacatggaccctgtggacacagccacatattactgtgcacggatgacactagggtatagcaggtcgtctctctactactactacggtatggacgtctggggccaagggaccacggtcaccgtctcctca

SEQ ID NO: 1354 - protein, 128 aa, Artificial Sequence
  synthetic
QVQLVESGPALVKPTQTLTLTCTFSGFSLSTSGMCVNWIRQPPGKALEWLTRIDWDDDKFYSTSLETRLTISKDTSKNQVVLTMTNMDPVDTATYYCARMTLGYSRSSLYYYYGMDVWGQGTTVTVSS

SEQ ID NO: 1355 - DNA, 30 bp, Artificial Sequence
  synthetic
gggttctcactcagcactagtggaatgtgt

SEQ ID NO: 1356 - protein, 10 aa, Artificial Sequence
  synthetic
GFSLSTSGMC

SEQ ID NO: 1357 - DNA, 21 bp, Artificial Sequence
  synthetic
attgattgggatgatgataag

SEQ ID NO: 1358 - protein, 7 aa, Artificial Sequence
  synthetic
IDWDDDK

SEQ ID NO: 1359 - DNA, 60 bp, Artificial Sequence
  synthetic
gcacggatgacactagggtatagcaggtcgtctctctactactactacggtatggacgtc

SEQ ID NO: 1360 - protein, 20 aa, Artificial Sequence
  synthetic
ARMTLGYSRSSLYYYYGMDV

SEQ ID NO: 1361 - DNA, 339 bp, Artificial Sequence
  synthetic
gacatcgtgatgacccagtctccagtctccctgcccgtcacccctggagagccggcctccatctcctgcaggtctagtcagcatctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggaatttattactgcatgcaagctctacaaactccgtacacttttggccaggggaccaaggtggagatcaaacga

SEQ ID NO: 1362 - protein, 113 aa, Artificial Sequence
  synthetic
DIVMTQSPVSLPVTPGEPASISCRSSQHLLHSNGYNYLDWYLQKPGQSPQLLIYLGSNRASGVPDRFSGSGSGTDFTLKISRVEAEDVGIYYCMQALQTPYTFGQGTKVEIKR

SEQ ID NO: 1363 - DNA, 33 bp, Artificial Sequence
  synthetic
cagcatctcctgcatagtaatggatacaactat

SEQ ID NO: 1364 - protein, 11 aa, Artificial Sequence
  synthetic
QHLLHSNGYNY

SEQ ID NO: 1365 - DNA, 9 bp, Artificial Sequence
  synthetic
ttgggttct

SEQ ID NO: 1366 - protein, 3 aa, Artificial Sequence
  synthetic
LGS

SEQ ID NO: 1367 - DNA, 27 bp, Artificial Sequence
  synthetic
atgcaagctctacaaactccgtacact

SEQ ID NO: 1368 - protein, 9 aa, Artificial Sequence
  synthetic
MQALQTPYT

SEQ ID NO: 1369 - DNA, 360 bp, Artificial Sequence
  synthetic
gaggtgcagctggtggagtctgggggagccttggtacagcctggggggtccctgagactctcctgtgtagcctctggattcacctttagcagctatgccatgacctgggtccgccaggctccagggaaggggctggagtgggtctcagctattagtggtagtggtgttaacacatactacacagactccgtgaagggccggttcaccatctccagagacaattccaagaacacgctgtatctgcaaatgaacagtctgagagccgaggacacggccgtatatttctgtgcgcaaagcggggatttttggagtggttcttatgactactggggccagggaaccctggtcaccgtctcctca

SEQ ID NO: 1370 - protein, 120 aa, Artificial Sequence
  synthetic
EVQLVESGGALVQPGGSLRLSCVASGFTFSSYAMTWVRQAPGKGLEWVSAISGSGVNTYYTDSVKGRFTISRDNSKNTLYLQMNSLRAEDTAVYFCAQSGDFWSGSYDYWGQGTLVTVSS

SEQ ID NO: 1371 - DNA, 24 bp, Artificial Sequence
  synthetic
ggattcacctttagcagctatgcc

SEQ ID NO: 1372 - protein, 8 aa, Artificial Sequence
  synthetic
GFTFSSYA

SEQ ID NO: 1373 - DNA, 24 bp, Artificial Sequence
  synthetic
attagtggtagtggtgttaacaca

SEQ ID NO: 1374 - protein, 8 aa, Artificial Sequence
  synthetic
ISGSGVNT

SEQ ID NO: 1375 - DNA, 39 bp, Artificial Sequence
  synthetic
gcgcaaagcggggatttttggagtggttcttatgactac

SEQ ID NO: 1376 - protein, 13 aa, Artificial Sequence
  synthetic
AQSGDFWSGSYDY

SEQ ID NO: 1377 - DNA, 324 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagttcctgatctatactgcatccagtttacaaagtggggtcccatcaaggttcagcggcagtggatctggcacagatttcactctcaccatcagcagcctgcagcctgaagattttgcaacttattactgtctacaagattacaattacccattcactttcggccctgggaccaaggtggagatcaaacga

SEQ ID NO: 1378 - protein, 108 aa, Artificial Sequence
  synthetic
DIQMTQSPSSLSASVGDRVTITCRASQGIRNDLGWYQQKPGKAPKFLIYTASSLQSGVPSRFSGSGSGTDFTLTISSLQPEDFATYYCLQDYNYPFTFGPGTKVEIKR

SEQ ID NO: 1379 - DNA, 18 bp, Artificial Sequence
  synthetic
cagggcattagaaatgat

SEQ ID NO: 1380 - protein, 6 aa, Artificial Sequence
  synthetic
QGIRND

SEQ ID NO: 1381 - DNA, 9 bp, Artificial Sequence
  synthetic
actgcatcc

SEQ ID NO: 1382 - protein, 3 aa, Artificial Sequence
  synthetic
TAS

SEQ ID NO: 1383 - DNA, 27 bp, Artificial Sequence
  synthetic
ctacaagattacaattacccattcact

SEQ ID NO: 1384 - protein, 9 aa, Artificial Sequence
  synthetic
LQDYNYPFT

SEQ ID NO: 1385 - DNA, 354 bp, Artificial Sequence
  synthetic
caggtgcagctggtggagtctgggggaggcttagtacagccgggggggtccctgagactctcctgtgcagcctctggattcacctttagcacctatgccatgagctgggtccgccaggctccagggaaggggctggagtggatctcagctattagtagtagtggtgttagcacatactacgcagactccgtgaagggccgcttcaccatctccagagacaattccaagaacacgctgtatctgcacctgaacagcctgagagccgacgacacggccgtatatcactgtgcgcaaggcaacagttggtactactttgattactggggccagggaaccacggtcaccgtctcctca

SEQ ID NO: 1386 - protein, 118 aa, Artificial Sequence
  synthetic
QVQLVESGGGLVQPGGSLRLSCAASGFTFSTYAMSWVRQAPGKGLEWISAISSSGVSTYYADSVKGRFTISRDNSKNTLYLHLNSLRADDTAVYHCAQGNSWYYFDYWGQGTTVTVSS

SEQ ID NO: 1387 - DNA, 24 bp, Artificial Sequence
  synthetic
ggattcacctttagcacctatgcc

SEQ ID NO: 1388 - protein, 8 aa, Artificial Sequence
  synthetic
GFTFSTYA

SEQ ID NO: 1389 - DNA, 24 bp, Artificial Sequence
  synthetic
attagtagtagtggtgttagcaca

SEQ ID NO: 1390 - protein, 8 aa, Artificial Sequence
  synthetic
ISSSGVST

SEQ ID NO: 1391 - DNA, 33 bp, Artificial Sequence
  synthetic
gcgcaaggcaacagttggtactactttgattac

SEQ ID NO: 1392 - protein, 11 aa, Artificial Sequence
  synthetic
AQGNSWYYFDY

SEQ ID NO: 1393 - DNA, 327 bp, Artificial Sequence
  synthetic
gacatcgtgatgacccagtctccaggcaccctgtctttctctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcggtgggtctgggacagacttcactctcaccatcagcagactggagcctgaagattttgctttgtattactgtcagcagtatggtggctcaccgatcaccttcggccaagggacacgactggagattaaacga

SEQ ID NO: 1394 - protein, 109 aa, Artificial Sequence
  synthetic
DIVMTQSPGTLSFSPGERATLSCRASQSVSSSYLAWYQQKPGQAPRLLIYGASSRATGIPDRFSGGGSGTDFTLTISRLEPEDFALYYCQQYGGSPITFGQGTRLEIKR

SEQ ID NO: 1395 - DNA, 21 bp, Artificial Sequence
  synthetic
cagagtgttagcagcagctac

SEQ ID NO: 1396 - protein, 7 aa, Artificial Sequence
  synthetic
QSVSSSY

SEQ ID NO: 1397 - DNA, 9 bp, Artificial Sequence
  synthetic
ggtgcatcc

SEQ ID NO: 1398 - protein, 3 aa, Artificial Sequence
  synthetic
GAS

SEQ ID NO: 1399 - DNA, 27 bp, Artificial Sequence
  synthetic
cagcagtatggtggctcaccgatcacc

SEQ ID NO: 1400 - protein, 9 aa, Artificial Sequence
  synthetic
QQYGGSPIT

SEQ ID NO: 1401 - DNA, 372 bp, Artificial Sequence; identical to SEQ ID NO: 1289
  synthetic

SEQ ID NO: 1402 - protein, 124 aa, Artificial Sequence; identical to SEQ ID NO: 1290
  synthetic

SEQ ID NO: 1403 - DNA, 24 bp, Artificial Sequence
  synthetic
ggattcacctttagcacctatgcc

SEQ ID NO: 1404 - protein, 8 aa, Artificial Sequence
  synthetic
GFTFSTYA

SEQ ID NO: 1405 - DNA, 24 bp, Artificial Sequence
  synthetic
attagtggtagtggtggtagttca

SEQ ID NO: 1406 - protein, 8 aa, Artificial Sequence
  synthetic
ISGSGGSS

SEQ ID NO: 1407 - DNA, 51 bp, Artificial Sequence; identical to SEQ ID NO: 1295
  synthetic

SEQ ID NO: 1408 - protein, 17 aa, Artificial Sequence
  synthetic
TKAGEQFALYYYYGMDV

SEQ ID NO: 1409 - DNA, 324 bp, Artificial Sequence; identical to SEQ ID NO: 1297
  synthetic

SEQ ID NO: 1410 - protein, 108 aa, Artificial Sequence; identical to SEQ ID NO: 1298
  synthetic

SEQ ID NO: 1411 - DNA, 18 bp, Artificial Sequence
  synthetic
caggacattagcagtttt

SEQ ID NO: 1412 - protein, 6 aa, Artificial Sequence
  synthetic
QDISSF

SEQ ID NO: 1413 - DNA, 9 bp, Artificial Sequence
  synthetic
tctgcatcc

SEQ ID NO: 1414 - protein, 3 aa, Artificial Sequence
  synthetic
SAS

SEQ ID NO: 1415 - DNA, 27 bp, Artificial Sequence
  synthetic
caacagcttaatagttatgcgctcact

SEQ ID NO: 1416 - protein, 9 aa, Artificial Sequence
  synthetic
QQLNSYALT

SEQ ID NO: 1417 - DNA, 360 bp, Artificial Sequence
  synthetic
gaggtgcagctggtggagtctgggggagccttggtacagcctggggggtccctgagactctcctgtgtagcctctggattcacctttagcagctatgccatgacatgggtccgccagggtccagggaaggggctggagtgggtctcagctattagtggtagtggtgttaacacatactacacagactccgtgaagggccggttcaccatctccagagacaattccaagaacacgctgtatctgcaaatgaacagcctgagagtcgaggacacggccgtatatttctgtgcgcaaagcggggatttttggagtggttcttatgactactggggccagggaaccctggtcaccgtctcctca

SEQ ID NO: 1418 - protein, 120 aa, Artificial Sequence
  synthetic
EVQLVESGGALVQPGGSLRLSCVASGFTFSSYAMTWVRQGPGKGLEWVSAISGSGVNTYYTDSVKGRFTISRDNSKNTLYLQMNSLRVEDTAVYFCAQSGDFWSGSYDYWGQGTLVTVSS

SEQ ID NO: 1419 - DNA, 24 bp, Artificial Sequence
  synthetic
ggattcacctttagcagctatgcc

SEQ ID NO: 1420 - protein, 8 aa, Artificial Sequence
  synthetic
GFTFSSYA

SEQ ID NO: 1421 - DNA, 24 bp, Artificial Sequence
  synthetic
attagtggtagtggtgttaacaca

SEQ ID NO: 1422 - protein, 8 aa, Artificial Sequence
  synthetic
ISGSGVNT

SEQ ID NO: 1423 - DNA, 39 bp, Artificial Sequence; identical to SEQ ID NO: 1375
  synthetic

SEQ ID NO: 1424 - protein, 13 aa, Artificial Sequence
  synthetic
AQSGDFWSGSYDY

SEQ ID NO: 1425 - DNA, 324 bp, Artificial Sequence
  synthetic
gacatcctgatgacccagtctccatcctccctgtctgcatctgtaggagacagagtcaccatcacttgccgggcaagtcagggcattagaaatgatttaggctggtatcagcagaaaccagggaaagcccctaagttcctgatctatactgcatccagtttacaaagtggggtcccatcaaggttcagcggcagtggatctggcacagatttcactctcaccatcagcagcctgcagcctgaagattttgcaacttattactgtctacaagattacaattacccattcactttcggccctgggaccaaggtggagatcaaacga

SEQ ID NO: 1426 - protein, 108 aa, Artificial Sequence
  synthetic
DILMTQSPSSLSASVGDRVTITCRASQGIRNDLGWYQQKPGKAPKFLIYTASSLQSGVPSRFSGSGSGTDFTLTISSLQPEDFATYYCLQDYNYPFTFGPGTKVEIKR

SEQ ID NO: 1427 - DNA, 18 bp, Artificial Sequence
  synthetic
cagggcattagaaatgat

SEQ ID NO: 1428 - protein, 6 aa, Artificial Sequence
  synthetic
QGIRND

SEQ ID NO: 1429 - DNA, 9 bp, Artificial Sequence
  synthetic
actgcatcc

SEQ ID NO: 1430 - protein, 3 aa, Artificial Sequence
  synthetic
TAS

SEQ ID NO: 1431 - DNA, 27 bp, Artificial Sequence
  synthetic
ctacaagattacaattacccattcact

SEQ ID NO: 1432 - protein, 9 aa, Artificial Sequence
  synthetic
LQDYNYPFT

SEQ ID NO: 1433 - DNA, 372 bp, Artificial Sequence
  synthetic
gaggtgcagctggtggagtctgggggagacttggtacagtcgggggggtccctgagactctcctgtgcagcctctggattcacctttagaaactatgccatgagttgggtccgccaggctccagggaaggggctggagtgggtctcaaccactagtggtagtggtggtagcccacactacgcagcctccgtgaagggccggttcaccatctccagagacaattccaagaatacgctgtatctgcaaatgaacagcctgagagccgaggacacggccgtatatttctgtgcgaaaatagatacagctatggccctctactactactacgctatggacgtctggggccaagggaccacggtcaccgtctcctca

SEQ ID NO: 1434 - protein, 124 aa, Artificial Sequence
  synthetic
EVQLVESGGDLVQSGGSLRLSCAASGFTFRNYAMSWVRQAPGKGLEWVSTTSGSGGSPHYAASVKGRFTISRDNSKNTLYLQMNSLRAEDTAVYFCAKIDTAMALYYYYAMDVWGQGTTVTVSS

SEQ ID NO: 1435 - DNA, 24 bp, Artificial Sequence
  synthetic
ggattcacctttagaaactatgcc

SEQ ID NO: 1436 - protein, 8 aa, Artificial Sequence
  synthetic
GFTFRNYA

SEQ ID NO: 1437 - DNA, 24 bp, Artificial Sequence
  synthetic
actagtggtagtggtggtagccca

SEQ ID NO: 1438 - protein, 8 aa, Artificial Sequence
  synthetic
TSGSGGSP

SEQ ID NO: 1439 - DNA, 51 bp, Artificial Sequence
  synthetic
gcgaaaatagatacagctatggccctctactactactacgctatggacgtc

SEQ ID NO: 1440 - protein, 17 aa, Artificial Sequence
  synthetic
AKIDTAMALYYYYAMDV

SEQ ID NO: 1441 - DNA, 324 bp, Artificial Sequence
  synthetic
gacatcctgatgacccagtctccatccttcctgtctgcatctgtaggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggagatcaaacga

SEQ ID NO: 1442 - protein, 108 aa, Artificial Sequence
  synthetic
DILMTQSPSFLSASVGDRVTITCWASQGISSYLAWYQQKPGKAPKLLIYAASTLQSGVPSRFSGSGSGTEFTLTISSLQPEDFATYYCQQLNSYPLTFGGGTKVEIKR

SEQ ID NO: 1443 - DNA, 18 bp, Artificial Sequence
  synthetic
cagggcattagcagttat

SEQ ID NO: 1444 - protein, 6 aa, Artificial Sequence
  synthetic
QGISSY

SEQ ID NO: 1445 - DNA, 9 bp, Artificial Sequence
  synthetic
gctgcatcc

SEQ ID NO: 1446 - protein, 3 aa, Artificial Sequence
  synthetic
AAS

SEQ ID NO: 1447 - DNA, 27 bp, Artificial Sequence
  synthetic
caacagcttaatagttaccctctcact

SEQ ID NO: 1448 - protein, 9 aa, Artificial Sequence
  synthetic
QQLNSYPLT

SEQ ID NO: 1449 - DNA, 375 bp, Artificial Sequence
  synthetic
caggtgcagctggtggagtcgggcccaggactggtgaggccttcggagaccctgtccctcacctgcactgtctctggtgcctccatcagtaattactactggagctggatccgacagaccccagggaagggactggagtggattggatatttccattatagtgggagaaccaactacaacccctccctcaagagtcgagtttctatatcagtggacacgtccaagaatcagttctccctgaacctgaactttgtgagcgccgcagacacggccgtttattactgtgcgcgggactccaaggtcattgcagcaatcccaagtgctcactggtatttcgatccctggggccgtggcacaatggtcaccgtctcctca

SEQ ID NO: 1450 - protein, 125 aa, Artificial Sequence
  synthetic
QVQLVESGPGLVRPSETLSLTCTVSGASISNYYWSWIRQTPGKGLEWIGYFHYSGRTNYNPSLKSRVSISVDTSKNQFSLNLNFVSAADTAVYYCARDSKVIAAIPSAHWYFDPWGRGTMVTVSS

SEQ ID NO: 1451 - DNA, 24 bp, Artificial Sequence
  synthetic
ggtgcctccatcagtaattactac

SEQ ID NO: 1452 - protein, 8 aa, Artificial Sequence
  synthetic
GASISNYY

SEQ ID NO: 1453 - DNA, 21 bp, Artificial Sequence
  synthetic
ttccattatagtgggagaacc

SEQ ID NO: 1454 - protein, 7 aa, Artificial Sequence
  synthetic
FHYSGRT

SEQ ID NO: 1455 - DNA, 57 bp, Artificial Sequence
  synthetic
gcgcgggactccaaggtcattgcagcaatcccaagtgctcactggtatttcgatccc

SEQ ID NO: 1456 - protein, 19 aa, Artificial Sequence
  synthetic
ARDSKVIAAIPSAHWYFDP

SEQ ID NO: 1457 - DNA, 324 bp, Artificial Sequence
  synthetic
gacatccagatgacccagtctccatcctccctgtctgcctctgtgggagacagagtcaccatcacttgccgggcaagtcagaacattagaacctatttaaattggtatcagcagaaaccagggaaagcccctaaattcctgatctatgctgcatccagtttgcgaagtggggtcccatcaaggttcagtggcagtggatctgggacagatttcactctcaccatcggcagtctgcaacctgaggactttgcaacttactactgtcaccagagttacggtaccccgatcaccttcggccaagggaccaaactggagatcaaacga

SEQ ID NO: 1458 - protein, 108 aa, Artificial Sequence
  synthetic
DIQMTQSPSSLSASVGDRVTITCRASQNIRTYLNWYQQKPGKAPKFLIYAASSLRSGVPSRFSGSGSGTDFTLTIGSLQPEDFATYYCHQSYGTPITFGQGTKLEIKR

SEQ ID NO: 1459 - DNA, 18 bp, Artificial Sequence
  synthetic
cagaacattagaacctat

SEQ ID NO: 1460 - protein, 6 aa, Artificial Sequence
  synthetic
QNIRTY

SEQ ID NO: 1461 - DNA, 9 bp, Artificial Sequence
  synthetic
gctgcatcc

SEQ ID NO: 1462 - protein, 3 aa, Artificial Sequence
  synthetic
AAS

SEQ ID NO: 1463 - DNA, 27 bp, Artificial Sequence
  synthetic
caccagagttacggtaccccgatcacc

SEQ ID NO: 1464 - protein, 9 aa, Artificial Sequence
  synthetic
HQSYGTPIT

SEQ ID NO: 1465 - DNA, 381 bp, Artificial Sequence
  synthetic
gaggtgcagctggtggagtcgggcccaggactggtgaagccttcggagaccctgtccctcacctgcactgtctctggtggctccatcagtaattactactggagctggatccggcagcccccagggaagggactggagtggattgggtatatctattacagtgggagcaccaaatacaacccctccctcaagagtcgagtcaccatatcagtagacacgtccaagaaccagttctccctgaaactgaattctgtgaccgctgcggacacggccgtgtattactgtgcgagagaggattacgatttttggagtgcccaaggggactactactattacggtgtggacgtctggggccaagggaccacggtcaccgtctcctca

SEQ ID NO: 1466 - protein, 127 aa, Artificial Sequence
  synthetic
EVQLVESGPGLVKPSETLSLTCTVSGGSISNYYWSWIRQPPGKGLEWIGYIYYSGSTKYNPSLKSRVTISVDTSKNQFSLKLNSVTAADTAVYYCAREDYDFWSAQGDYYYYGVDVWGQGTTVTVSS

SEQ ID NO: 1467 - DNA, 24 bp, Artificial Sequence
  synthetic
ggtggctccatcagtaattactac

SEQ ID NO: 1468 - protein, 8 aa, Artificial Sequence
  synthetic
GGSISNYY

SEQ ID NO: 1469 - DNA, 21 bp, Artificial Sequence
  synthetic
atctattacagtgggagcacc

SEQ ID NO: 1470 - protein, 7 aa, Artificial Sequence
  synthetic
IYYSGST

SEQ ID NO: 1471 - DNA, 63 bp, Artificial Sequence
  synthetic
gcgagagaggattacgatttttggagtgcccaaggggactactactattacggtgtggacgtc

SEQ ID NO: 1472 - protein, 21 aa, Artificial Sequence
  synthetic
AREDYDFWSAQGDYYYYGVDV

SEQ ID NO: 1473 - DNA, 324 bp, Artificial Sequence
  synthetic
gacatcctgatgacccagtctccatcttccgtgtctgcatctgtaggagacagagtcaccatcacttgtcgggcgagtcaggatattagcaactggttagcctggtatcagcagaaaccagggaaagcccctaagctcctgatctatgatgcatccagtttgcaaagtggggtcccatcaaggttcagcggcggtggatctgggacagatttcactctcaccatcagcagcctgcagcctgaagattttgcaacttactattgtcaacaggctaacagtttcccgctcactttcggcggagggaccaaggtggaaatcaaacga

SEQ ID NO: 1474 - protein, 108 aa, Artificial Sequence
  synthetic
DILMTQSPSSVSASVGDRVTITCRASQDISNWLAWYQQKPGKAPKLLIYDASSLQSGVPSRFSGGGSGTDFTLTISSLQPEDFATYYCQQANSFPLTFGGGTKVEIKR

SEQ ID NO: 1475 - DNA, 18 bp, Artificial Sequence
  synthetic
caggatattagcaactgg

SEQ ID NO: 1476 - protein, 6 aa, Artificial Sequence
  synthetic
QDISNW

SEQ ID NO: 1477 - DNA, 9 bp, Artificial Sequence
  synthetic
gatgcatcc

SEQ ID NO: 1478 - protein, 3 aa, Artificial Sequence
  synthetic
DAS

SEQ ID NO: 1479 - DNA, 27 bp, Artificial Sequence
  synthetic
caacaggctaacagtttcccgctcact

SEQ ID NO: 1480 - protein, 9 aa, Artificial Sequence
  synthetic
QQANSFPLT

SEQ ID NO: 1481 - DNA, 363 bp, Artificial Sequence
  synthetic
gaggtgcagctggtggagtcgggcccaggactggtgaagccttcggagaccctgtccctcacctgcactgtctctggtggctccatcagtacttactactggaattggatccggcagcccccagggaagggactggaattgattgggtatatctataagagtgggaaaaacaattataatccctccctcaagagtcgcgtcaccataaaagtagacacgtccaagaaccagttgtccctgaacctgagctctgtcaccgctgcggacacggccgtgtattattgtgcgcgagagggggggggactccctacggggggatattttgaccagtggggccagggaaccctggtcaccgtctcctca

SEQ ID NO: 1482 - protein, 121 aa, Artificial Sequence
  synthetic
EVQLVESGPGLVKPSETLSLTCTVSGGSISTYYWNWIRQPPGKGLELIGYIYKSGKNNYNPSLKSRVTIKVDTSKNQLSLNLSSVTAADTAVYYCAREGGGLPTGGYFDQWGQGTLVTVSS

SEQ ID NO: 1483 - DNA, 24 bp, Artificial Sequence
  synthetic
ggtggctccatcagtacttactac

SEQ ID NO: 1484 - protein, 8 aa, Artificial Sequence
  synthetic
GGSISTYY

SEQ ID NO: 1485 - DNA, 21 bp, Artificial Sequence
  synthetic
atctataagagtgggaaaaac

SEQ ID NO: 1486 - protein, 7 aa, Artificial Sequence
  synthetic
IYKSGKN

SEQ ID NO: 1487 - DNA, 45 bp, Artificial Sequence
  synthetic
gcgcgagagggggggggactccctacggggggatattttgaccag

SEQ ID NO: 1488 - protein, 15 aa, Artificial Sequence
  synthetic
AREGGGLPTGGYFDQ

SEQ ID NO: 1489 - DNA, 324 bp, Artificial Sequence
  synthetic
gacatccagatgacccagtctccatcctccctgtctgcatctgtaggagacagagtcaccatcacttgccgggcaagtcaaaacattaggagttatttaaattggtatcaactgaaaccaggaaaagcccctaatctcctgatctatgctgcatccaatttgcaaagtggggtcccatcaaggttcagtggcagtggatctgggacagatttcactctcaccatcagcagtctgcaacctgaagattttgcaacttactcctgtcaacagagttacagtcacccttacacttttggccaggggaccaaggtggagatcaaacga

SEQ ID NO: 1490 - protein, 108 aa, Artificial Sequence
  synthetic
DIQMTQSPSSLSASVGDRVTITCRASQNIRSYLNWYQLKPGKAPNLLIYAASNLQSGVPSRFSGSGSGTDFTLTISSLQPEDFATYSCQQSYSHPYTFGQGTKVEIKR

SEQ ID NO: 1491 - DNA, 18 bp, Artificial Sequence
  synthetic
caaaacattaggagttat

SEQ ID NO: 1492 - protein, 6 aa, Artificial Sequence
  synthetic
QNIRSY

SEQ ID NO: 1493 - DNA, 9 bp, Artificial Sequence
  synthetic
gctgcatcc

SEQ ID NO: 1494 - protein, 3 aa, Artificial Sequence
  synthetic
AAS

SEQ ID NO: 1495 - DNA, 27 bp, Artificial Sequence
  synthetic
caacagagttacagtcacccttacact

SEQ ID NO: 1496 - protein, 9 aa, Artificial Sequence
  synthetic
QQSYSHPYT

SEQ ID NO: 1497 - DNA, 363 bp, Artificial Sequence
  synthetic
gaggtgcagctggtggagtcgggcccaggactggtgaagccttcggagaccctgtccctcacctgcactgtctctggtggctccatcagtacttactactggaattggatccggcagtccccagggaagggactggaattgattgggtatatctataagagtggaagaaacttctataatccctccctcaagagtcgagtcaccatagcagtagacacgtccacgaaccagttgtcgctgaggttgacctcagtgaccgctgcggacacggccgtgtattactgtgtgagagagggggggggactccctacggggggatactttgactcctggggccagggaaccacggtcaccgtctcctca

SEQ ID NO: 1498 - protein, 121 aa, Artificial Sequence
  synthetic
EVQLVESGPGLVKPSETLSLTCTVSGGSISTYYWNWIRQSPGKGLELIGYIYKSGRNFYNPSLKSRVTIAVDTSTNQLSLRLTSVTAADTAVYYCVREGGGLPTGGYFDSWGQGTTVTVSS

SEQ ID NO: 1499 - DNA, 24 bp, Artificial Sequence
  synthetic
ggtggctccatcagtacttactac

SEQ ID NO: 1500 - protein, 8 aa, Artificial Sequence
  synthetic
GGSISTYY

SEQ ID NO: 1501 - DNA, 21 bp, Artificial Sequence
  synthetic
atctataagagtggaagaaac

SEQ ID NO: 1502 - protein, 7 aa, Artificial Sequence
  synthetic
IYKSGRN

SEQ ID NO: 1503 - DNA, 45 bp, Artificial Sequence
  synthetic
gtgagagagggggggggactccctacggggggatactttgactcc

SEQ ID NO: 1504 - protein, 15 aa, Artificial Sequence
  synthetic
VREGGGLPTGGYFDS

SEQ ID NO: 1505 - DNA, 324 bp, Artificial Sequence
  synthetic
gacatcctgatgacccagtctccatcctccctgtctgcatctgtaggagacagagtcaccatcacttgccgggcaagtcaaaacattaggaattatttaaattggtatcaactgaaaccagggaaagcccctaacctcctgatctatgctacatccaatttgcaaagtggggtcccatcaaggttcagtggcagtggatctgggacagatttcactctctccatcagcagtctgcaacctgaagattttgcaacttactcctgtcaacagagttacagtaacccttacacttttggccaggggaccaaggtggagatcaaacga

SEQ ID NO: 1506 - protein, 108 aa, Artificial Sequence
  synthetic
DILMTQSPSSLSASVGDRVTITCRASQNIRNYLNWYQLKPGKAPNLLIYATSNLQSGVPSRFSGSGSGTDFTLSISSLQPEDFATYSCQQSYSNPYTFGQGTKVEIKR

SEQ ID NO: 1507 - DNA, 18 bp, Artificial Sequence
  synthetic
caaaacattaggaattat

SEQ ID NO: 1508 - protein, 6 aa, Artificial Sequence
  synthetic
QNIRNY

SEQ ID NO: 1509 - DNA, 9 bp, Artificial Sequence
  synthetic
gctacatcc

SEQ ID NO: 1510 - protein, 3 aa, Artificial Sequence
  synthetic
ATS

SEQ ID NO: 1511 - DNA, 27 bp, Artificial Sequence
  synthetic
caacagagttacagtaacccttacact

SEQ ID NO: 1512 - protein, 9 aa, Artificial Sequence
  synthetic
QQSYSNPYT

SEQ ID NO: 1513 - DNA, 357 bp, Artificial Sequence
  synthetic
gaggtgcagctggtggagtctgggggaggcttggtacagcctggggggtccctgagactctcctgtgcagcctctggattcacctttagcagctatgccatgagctgggtccgccaggctccagggagggggctggagtgggtctcaggtattagtggtggtagtggtagtacatactacgcagactccgtgaagggccgattcaccatctccagagacaattccaagaacacgctgtatctgcaaatgaacagcctgagggccgaggacacggccgtatattactgtgcgaggtggcaacgattagaggactggttcgacccctggggccagggaaccctggtcaccgtctcctca

SEQ ID NO: 1514 - protein, 119 aa, Artificial Sequence
  synthetic
EVQLVESGGGLVQPGGSLRLSCAASGFTFSSYAMSWVRQAPGRGLEWVSGISGGSGSTYYADSVKGRFTISRDNSKNTLYLQMNSLRAEDTAVYYCARWQRLEDWFDPWGQGTLVTVSS

SEQ ID NO: 1515 - DNA, 24 bp, Artificial Sequence
  synthetic
ggattcacctttagcagctatgcc

SEQ ID NO: 1516 - protein, 8 aa, Artificial Sequence
  synthetic
GFTFSSYA

SEQ ID NO: 1517 - DNA, 24 bp, Artificial Sequence
  synthetic
attagtggtggtagtggtagtaca

SEQ ID NO: 1518 - protein, 8 aa, Artificial Sequence
  synthetic
ISGGSGST

SEQ ID NO: 1519 - DNA, 36 bp, Artificial Sequence; identical to SEQ ID NO: 1263
  synthetic

SEQ ID NO: 1520 - protein, 12 aa, Artificial Sequence
  synthetic
ARWQRLEDWFDP

SEQ ID NO: 1521 - DNA, 324 bp, Artificial Sequence
  synthetic
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttacttttgtcaacagagttacagtaccccgtacacttttggccaggggaccaaggtggagatcaaacga

SEQ ID NO: 1522 - protein, 108 aa, Artificial Sequence
  synthetic
DIQMTQSPSSLSASVGDRVTITCRASQSISNYLNWYQQKPGKAPKLLIYAASSLQSGVPSRFSGSGSGTDFTLTISSLQPEDFATYFCQQSYSTPYTFGQGTKVEIKR

SEQ ID NO: 1523 - DNA, 18 bp, Artificial Sequence
  synthetic
cagagcattagcaactat

SEQ ID NO: 1524 - protein, 6 aa, Artificial Sequence
  synthetic
QSISNY

SEQ ID NO: 1525 - DNA, 9 bp, Artificial Sequence
  synthetic
gctgcatcc

SEQ ID NO: 1526 - protein, 3 aa, Artificial Sequence
  synthetic
AAS

SEQ ID NO: 1527 - DNA, 27 bp, Artificial Sequence
  synthetic
caacagagttacagtaccccgtacact

SEQ ID NO: 1528 - protein, 9 aa, Artificial Sequence
  synthetic
QQSYSTPYT

SEQ ID NO: 1529 - DNA, 354 bp, Artificial Sequence
  synthetic
gaggtgcagctggtggagtcgggcccaggactggtgaggccttcggagaccctgtccctcacctgcactgtctctggtgcctccattagtggttattattgcagttggatccggcagcccccaggtaagggactggagtggattggatatatctattacagtgggagcagcaagtacaacccctccctcgagagtcgagtcaccatgtcagtagacacgtccaagaaccagttctccctgaggctgaggtctgtgaccgctgcggacacggccgtgtattactgtgcgagagatgacggggactacaatggtatggacgtctggggccaggggaccacggtcaccgtctcctca

SEQ ID NO: 1530 - protein, 118 aa, Artificial Sequence
  synthetic
EVQLVESGPGLVRPSETLSLTCTVSGASISGYYCSWIRQPPGKGLEWIGYIYYSGSSKYNPSLESRVTMSVDTSKNQFSLRLRSVTAADTAVYYCARDDGDYNGMDVWGQGTTVTVSS

SEQ ID NO: 1531 - DNA, 24 bp, Artificial Sequence
  synthetic
ggtgcctccattagtggttattat

SEQ ID NO: 1532 - protein, 8 aa, Artificial Sequence
  synthetic
GASISGYY

SEQ ID NO: 1533 - DNA, 21 bp, Artificial Sequence
  synthetic
atctattacagtgggagcagc

SEQ ID NO: 1534 - protein, 7 aa, Artificial Sequence
  synthetic
IYYSGSS

SEQ ID NO: 1535 - DNA, 36 bp, Artificial Sequence
  synthetic
gcgagagatgacggggactacaatggtatggacgtc

SEQ ID NO: 1536 - protein, 12 aa, Artificial Sequence
  synthetic
ARDDGDYNGMDV

SEQ ID NO: 1537 - DNA, 339 bp, Artificial Sequence
  synthetic
gacatcctgatgacccagtctccactctccctgcccgtcacccttggacaggcggcctccatctcctgtaggtctagtgaaggcctcatatacagtgatggaaagtcctacttgaattggtttcaccagaggccaggccagcctccaaggcgcctaatttataaggtttctaaccgggactctggggtcccagacagattcagcggcagtgggtcaggcactgatttcacactgaaaatcagcagggtggaggctgaggatgttggactttattactgcatgcaaagtacccactggccgctcactttcggcggagggaccaaggtggagatcaaacga

SEQ ID NO: 1538 - protein, 113 aa, Artificial Sequence
  synthetic
DILMTQSPLSLPVTLGQAASISCRSSEGLIYSDGKSYLNWFHQRPGQPPRRLIYKVSNRDSGVPDRFSGSGSGTDFTLKISRVEAEDVGLYYCMQSTHWPLTFGGGTKVEIKR

SEQ ID NO: 1539 - DNA, 33 bp, Artificial Sequence
  synthetic
gaaggcctcatatacagtgatggaaagtcctac

SEQ ID NO: 1540 - protein, 11 aa, Artificial Sequence
  synthetic
EGLIYSDGKSY

SEQ ID NO: 1541 - DNA, 9 bp, Artificial Sequence
  synthetic
aaggtttct

SEQ ID NO: 1542 - protein, 3 aa, Artificial Sequence
  synthetic
KVS

SEQ ID NO: 1543 - DNA, 27 bp, Artificial Sequence
  synthetic
atgcaaagtacccactggccgctcact

SEQ ID NO: 1544 - protein, 9 aa, Artificial Sequence
  synthetic
MQSTHWPLT

SEQ ID NO: 1545 - DNA, 354 bp, Artificial Sequence
  synthetic
gaggtgcagctggtggagtctgggggaggcttggtacagcctggggggtccctgagactctcctgtgcagcctctggattcacctttagcacccatgccatgagctgggtccgccaggctccagggaaggggctggagtgggtctcagctattagtagtagtggtggtagcacatactacgcagtacccgtgaagggccggttcaccatctccagagacaattccaagaacacgctgtatctgcaaatgaacagcctgagagccgaggacacggccgtatattactgtgtggaaggcaacagctggtactactttgagtactggggccagggaaccctggtcaccgtctcctca

SEQ ID NO: 1546 - protein, 118 aa, Artificial Sequence
  synthetic
EVQLVESGGGLVQPGGSLRLSCAASGFTFSTHAMSWVRQAPGKGLEWVSAISSSGGSTYYAVPVKGRFTISRDNSKNTLYLQMNSLRAEDTAVYYCVEGNSWYYFEYWGQGTLVTVSS

SEQ ID NO: 1547 - DNA, 24 bp, Artificial Sequence
  synthetic
ggattcacctttagcacccatgcc

SEQ ID NO: 1548 - protein, 8 aa, Artificial Sequence
  synthetic
GFTFSTHA

SEQ ID NO: 1549 - DNA, 24 bp, Artificial Sequence
  synthetic
attagtagtagtggtggtagcaca

SEQ ID NO: 1550 - protein, 8 aa, Artificial Sequence
  synthetic
ISSSGGST

SEQ ID NO: 1551 - DNA, 33 bp, Artificial Sequence
  synthetic
gtggaaggcaacagctggtactactttgagtac

SEQ ID NO: 1552 - protein, 11 aa, Artificial Sequence
  synthetic
VEGNSWYYFEY

SEQ ID NO: 1553 - DNA, 327 bp, Artificial Sequence
  synthetic
gacatcgtgatgacccagtctccaggcaccctgtctttgtctccaggggaaagagccaccctctcctgcagggccagtcagagtgttagcagcaactacttagcctggtaccagcagaaacctggccaggctcccaggctcctcatctatggtacatccagcagggccactggcatcccagacaggttcagtggcagtgggtctgggacagacttcactctcaccgtcagcagactggagcctgaagattttgcagtgtattactgtcagcagtatggtggctcaccgatcaccttcggccaagggacacgactggagattaaacga

SEQ ID NO: 1554 - protein, 109 aa, Artificial Sequence
  synthetic
DIVMTQSPGTLSLSPGERATLSCRASQSVSSNYLAWYQQKPGQAPRLLIYGTSSRATGIPDRFSGSGSGTDFTLTVSRLEPEDFAVYYCQQYGGSPITFGQGTRLEIKR

SEQ ID NO: 1555 - DNA, 21 bp, Artificial Sequence
  synthetic
cagagtgttagcagcaactac

SEQ ID NO: 1556 - protein, 7 aa, Artificial Sequence
  synthetic
QSVSSNY

SEQ ID NO: 1557 - DNA, 9 bp, Artificial Sequence
  synthetic
ggtacatcc

SEQ ID NO: 1558 - protein, 3 aa, Artificial Sequence
  synthetic
GTS

SEQ ID NO: 1559 - DNA, 27 bp, Artificial Sequence
  synthetic
cagcagtatggtggctcaccgatcacc

SEQ ID NO: 1560 - protein, 9 aa, Artificial Sequence
  synthetic
QQYGGSPIT

SEQ ID NO: 1561 - DNA, 363 bp, Artificial Sequence
  synthetic
gaggtgcagctggtggagtcgggcccaggactggtgaagccttcggagaccctgtccctcacctgcactgtctctggtggctccatcagtacttactactggaattggatccggcagcccccagggaagggactggaattgattggatatatctataagagtggaagaaacttcaataatccctccctcaagagtcgagtcaccatagcagtagacacgtccacgaaccagttgtcgctgaagttgacctcagtgaccgctgcggacacggccgtgtattactgtgcgagagagggggggggactcccaacggggggatactatgactcctggggccagggaaccctggtcaccgtctcctca

SEQ ID NO: 1562 - protein, 121 aa, Artificial Sequence
  synthetic
EVQLVESGPGLVKPSETLSLTCTVSGGSISTYYWNWIRQPPGKGLELIGYIYKSGRNFNNPSLKSRVTIAVDTSTNQLSLKLTSVTAADTAVYYCAREGGGLPTGGYYDSWGQGTLVTVSS

SEQ ID NO: 1563 - DNA, 24 bp, Artificial Sequence
  synthetic
ggtggctccatcagtacttactac

SEQ ID NO: 1564 - protein, 8 aa, Artificial Sequence
  synthetic
GGSISTYY

SEQ ID NO: 1565 - DNA, 21 bp, Artificial Sequence
  synthetic
atctataagagtggaagaaac

SEQ ID NO: 1566 - protein, 7 aa, Artificial Sequence
  synthetic
IYKSGRN

SEQ ID NO: 1567 - DNA, 45 bp, Artificial Sequence
  synthetic
gcgagagagggggggggactcccaacggggggatactatgactcc

SEQ ID NO: 1568 - protein, 15 aa, Artificial Sequence
  synthetic
AREGGGLPTGGYYDS

SEQ ID NO: 1569 - DNA, 324 bp, Artificial Sequence
  synthetic
gacatccagatgacccagtctccatcctccctgtctgcatctgtaggagacagagtcaccatcacttgccgggcaagtcaaaacattaggaattatttaaattggtatcaactgaaaccagggaaagcccctaacctcctgatctatgctacatccaatttgcaaagtggggtcccatcaaggttcagtggcagtggatctgggacagatttcactctctccatcagcagtctgcaacctgaagattttgcaacttactcctgtcaacagagttacagtaacccttacacttttggccaggggaccaaggtggagatcaaacga

SEQ ID NO: 1570 - protein, 108 aa, Artificial Sequence
  synthetic
DIQMTQSPSSLSASVGDRVTITCRASQNIRNYLNWYQLKPGKAPNLLIYATSNLQSGVPSRFSGSGSGTDFTLSISSLQPEDFATYSCQQSYSNPYTFGQGTKVEIKR

SEQ ID NO: 1571 - DNA, 18 bp, Artificial Sequence
  synthetic
caaaacattaggaattat

SEQ ID NO: 1572 - protein, 6 aa, Artificial Sequence
  synthetic
QNIRNY

SEQ ID NO: 1573 - DNA, 9 bp, Artificial Sequence
  synthetic
gctacatcc

SEQ ID NO: 1574 - protein, 3 aa, Artificial Sequence
  synthetic
ATS

SEQ ID NO: 1575 - DNA, 27 bp, Artificial Sequence
  synthetic
caacagagttacagtaacccttacact

SEQ ID NO: 1576 - protein, 9 aa, Artificial Sequence
  synthetic
QQSYSNPYT

SEQ ID NO: 1577 - DNA, 363 bp, Artificial Sequence
  synthetic
caggtgcagctggtggagtcgggcccaggactggtgaagccttcggagaccctgtccctcacctgcactgtctctggtggctccatcagtacttactactggaattggatccggcagcccccagggaagggactggaattgattggatatatctataagagtggaagaaacttcaataatccctccctcaagagtcgagtcaccatagcagtagacacgtccacgaaccagttgtcgctgaagttgacctcagtgaccgctgcggacacggccgtgtattactgtgcgagagagggggggggactcccaacggggggatactatgactcctggggccagggaaccctggtcaccgtctcctca

SEQ ID NO: 1578 - protein, 121 aa, Artificial Sequence
  synthetic
QVQLVESGPGLVKPSETLSLTCTVSGGSISTYYWNWIRQPPGKGLELIGYIYKSGRNFNNPSLKSRVTIAVDTSTNQLSLKLTSVTAADTAVYYCAREGGGLPTGGYYDSWGQGTLVTVSS

SEQ ID NO: 1579 - DNA, 24 bp, Artificial Sequence
  synthetic
ggtggctccatcagtacttactac

SEQ ID NO: 1580 - protein, 8 aa, Artificial Sequence
  synthetic
GGSISTYY

SEQ ID NO: 1581 - DNA, 21 bp, Artificial Sequence
  synthetic
atctataagagtggaagaaac

SEQ ID NO: 1582 - protein, 7 aa, Artificial Sequence
  synthetic
IYKSGRN

SEQ ID NO: 1583 - DNA, 45 bp, Artificial Sequence; identical to SEQ ID NO: 1567
  synthetic

SEQ ID NO: 1584 - protein, 15 aa, Artificial Sequence
  synthetic
AREGGGLPTGGYYDS

SEQ ID NO: 1585 - DNA, 324 bp, Artificial Sequence; identical to SEQ ID NO: 1569
  synthetic

SEQ ID NO: 1586 - protein, 108 aa, Artificial Sequence; identical to SEQ ID NO: 1570
  synthetic

SEQ ID NO: 1587 - DNA, 18 bp, Artificial Sequence
  synthetic
caaaacattaggaattat

SEQ ID NO: 1588 - protein, 6 aa, Artificial Sequence
  synthetic
QNIRNY

SEQ ID NO: 1589 - DNA, 9 bp, Artificial Sequence
  synthetic
gctacatcc

SEQ ID NO: 1590 - protein, 3 aa, Artificial Sequence
  synthetic
ATS

SEQ ID NO: 1591 - DNA, 27 bp, Artificial Sequence
  synthetic
caacagagttacagtaacccttacact

SEQ ID NO: 1592 - protein, 9 aa, Artificial Sequence
  synthetic
QQSYSNPYT

SEQ ID NO: 1593 - DNA, 375 bp, Artificial Sequence
  synthetic
caggtgcagctggtggagtcgggcccaggactggtgaggccttcggagaccctgtccctcacctgcactgtctctggtggctccatcagtaatgactactggagctggatccgacagaccccagggaagggactggagtggattggatatttccattatagtgggagaaccaactacaacccctccctcaagagtcgagtttctatatcagtggacacgtccaagaatcagttctccctgaacctgagctttgtgagcgccgcagacacggccgtttattactgtgcgcgggactccaaggtcattgcagcaatcccaagtgctcactggtatttcgatccctggggccgtggcacactggtcaccgtctcctca

SEQ ID NO: 1594 - protein, 125 aa, Artificial Sequence
  synthetic
QVQLVESGPGLVRPSETLSLTCTVSGGSISNDYWSWIRQTPGKGLEWIGYFHYSGRTNYNPSLKSRVSISVDTSKNQFSLNLSFVSAADTAVYYCARDSKVIAAIPSAHWYFDPWGRGTLVTVSS

SEQ ID NO: 1595 - DNA, 24 bp, Artificial Sequence
  synthetic
ggtggctccatcagtaatgactac

SEQ ID NO: 1596 - protein, 8 aa, Artificial Sequence
  synthetic
GGSISNDY

SEQ ID NO: 1597 - DNA, 21 bp, Artificial Sequence
  synthetic
ttccattatagtgggagaacc

SEQ ID NO: 1598 - protein, 7 aa, Artificial Sequence
  synthetic
FHYSGRT

SEQ ID NO: 1599 - DNA, 57 bp, Artificial Sequence; identical to SEQ ID NO: 1455
  synthetic

SEQ ID NO: 1600 - protein, 19 aa, Artificial Sequence
  synthetic
ARDSKVIAAIPSAHWYFDP

SEQ ID NO: 1601 - DNA, 324 bp, Artificial Sequence
  synthetic
gacatcctgatgacccagtctccatcctccctgtctgcctctgtgggagacagagtcaccatcacttgccgggcaagtcagaacattagaacctatttaaattggtatcagcagaaaccagggaaagcccctaaactcctgatctatgctgcatccagtttgcgaagtgaggtcccatcaaggttcagtggcagtggatctgggacagatttcactctcaccatcggcagtctgcaacctgaggactttgcaacttactactgtcaccagagttacggtaccccgatcaccttcggccaagggaccaaactggagatcaaacga

SEQ ID NO: 1602 - protein, 108 aa, Artificial Sequence
  synthetic
DILMTQSPSSLSASVGDRVTITCRASQNIRTYLNWYQQKPGKAPKLLIYAASSLRSEVPSRFSGSGSGTDFTLTIGSLQPEDFATYYCHQSYGTPITFGQGTKLEIKR

SEQ ID NO: 1603 - DNA, 18 bp, Artificial Sequence
  synthetic
cagaacattagaacctat

SEQ ID NO: 1604 - protein, 6 aa, Artificial Sequence
  synthetic
QNIRTY

SEQ ID NO: 1605 - DNA, 9 bp, Artificial Sequence
  synthetic
gctgcatcc

SEQ ID NO: 1606 - protein, 3 aa, Artificial Sequence
  synthetic
AAS

SEQ ID NO: 1607 - DNA, 27 bp, Artificial Sequence
  synthetic
caccagagttacggtaccccgatcacc

SEQ ID NO: 1608 - protein, 9 aa, Artificial Sequence
  synthetic
HQSYGTPIT

SEQ ID NO: 1609 - DNA, 363 bp, Artificial Sequence
  synthetic
gaggtgcagctggtggagtcgggcccaggactggtgaagccttcggagaccctgtccctcacctgcactgtctctggtggctccatcagtacttactactggaattggatccggcagcccccagggaagggactggaattgattgggtatatctataagagtggaagaaacttctataatccctccctcaagagtcgagtcatcatagcagtagacacgtccacgaaccagttgtcgctgaagttgacctcagtgaccgctgcggacacggccgtgtattactgtgcgagagagggggggggactccctacggggggatactttgactcctggggccagggaaccctggtcaccgtctcctca

SEQ ID NO: 1610 - protein, 121 aa, Artificial Sequence
  synthetic
EVQLVESGPGLVKPSETLSLTCTVSGGSISTYYWNWIRQPPGKGLELIGYIYKSGRNFYNPSLKSRVIIAVDTSTNQLSLKLTSVTAADTAVYYCAREGGGLPTGGYFDSWGQGTLVTVSS

SEQ ID NO: 1611 - DNA, 24 bp, Artificial Sequence
  synthetic
ggtggctccatcagtacttactac

SEQ ID NO: 1612 - protein, 8 aa, Artificial Sequence
  synthetic
GGSISTYY

SEQ ID NO: 1613 - DNA, 21 bp, Artificial Sequence
  synthetic
atctataagagtggaagaaac

SEQ ID NO: 1614 - protein, 7 aa, Artificial Sequence
  synthetic
IYKSGRN

SEQ ID NO: 1615 - DNA, 45 bp, Artificial Sequence
  synthetic
gcgagagagggggggggactccctacggggggatactttgactcc

SEQ ID NO: 1616 - protein, 15 aa, Artificial Sequence
  synthetic
AREGGGLPTGGYFDS

SEQ ID NO: 1617 - DNA, 324 bp, Artificial Sequence
  synthetic
gacatcctgatgacccagtctccatcctccctgtctgcatctgtaggagacagagtcaccatcacttgccgggcaagtcaaaacattaggaattatttaaattggtatcaactgaaaccagggaaagcccctaacctcctgatctatgctacatccaatttgcaaaatggggtcccatcaaggttcagtggcagtggatctgggacagatttcactctctccatcagcagtctgcaacctgaagattttgcaacttactcctgtcaacagagttacagtaacccttacacttttggccaggggaccaaggtggagatcaaacga

SEQ ID NO: 1618 - protein, 108 aa, Artificial Sequence
  synthetic
DILMTQSPSSLSASVGDRVTITCRASQNIRNYLNWYQLKPGKAPNLLIYATSNLQNGVPSRFSGSGSGTDFTLSISSLQPEDFATYSCQQSYSNPYTFGQGTKVEIKR

SEQ ID NO: 1619 - DNA, 18 bp, Artificial Sequence
  synthetic
caaaacattaggaattat

SEQ ID NO: 1620 - protein, 6 aa, Artificial Sequence
  synthetic
QNIRNY

SEQ ID NO: 1621 - DNA, 9 bp, Artificial Sequence
  synthetic
gctacatcc

SEQ ID NO: 1622 - protein, 3 aa, Artificial Sequence
  synthetic
ATS

SEQ ID NO: 1623 - DNA, 27 bp, Artificial Sequence
  synthetic
caacagagttacagtaacccttacact

SEQ ID NO: 1624 - protein, 9 aa, Artificial Sequence
  synthetic
QQSYSNPYT

SEQ ID NO: 1625 - DNA, 375 bp, Artificial Sequence
  synthetic
gaggtgcagctggtggagtcgggcccaggactggtgaggccttcggagaccctgtccctcacctgcactgtctctggtgcctccatcagtaattactactggagctggatccgacagaccccagggaagggactggagtggattggatatttccattatagtgggagaaccaactacaacccctccctcaagagtcgagtttctatatcagtggacacgtccaagaatcagttctccctgaacctgaactttgtgagcgccgcagacacggccgtttattactgtgcgcgggactccaaggtcattgcagcaatcccaagtgctcactggtatttcgatccctggggccgtggcacaatggtcaccgtctcctca

SEQ ID NO: 1626 - protein, 125 aa, Artificial Sequence
  synthetic
EVQLVESGPGLVRPSETLSLTCTVSGASISNYYWSWIRQTPGKGLEWIGYFHYSGRTNYNPSLKSRVSISVDTSKNQFSLNLNFVSAADTAVYYCARDSKVIAAIPSAHWYFDPWGRGTMVTVSS

SEQ ID NO: 1627 - DNA, 24 bp, Artificial Sequence
  synthetic
ggtgcctccatcagtaattactac

SEQ ID NO: 1628 - protein, 8 aa, Artificial Sequence
  synthetic
GASISNYY

SEQ ID NO: 1629 - DNA, 21 bp, Artificial Sequence
  synthetic
ttccattatagtgggagaacc

SEQ ID NO: 1630 - protein, 7 aa, Artificial Sequence
  synthetic
FHYSGRT

SEQ ID NO: 1631 - DNA, 57 bp, Artificial Sequence; identical to SEQ ID NO: 1455
  synthetic

SEQ ID NO: 1632 - protein, 19 aa, Artificial Sequence
  synthetic
ARDSKVIAAIPSAHWYFDP

SEQ ID NO: 1633 - DNA, 324 bp, Artificial Sequence
  synthetic
gacatccagatgacccagtctccatcctccctgtctgcctctgtgggagacagagtcaccatcacttgccgggcaagtcagaacattagaacctatttaaattggtatcagcagaaaccagggaaagcccctaaattcctgatctatgctgcatccagtttgcgaagtggggtcccatcaaggttcagtggcagtggatctgggacagatttcactctcaccatcggcagtctgcaacctgaggactttgcaacttactactgtcaccagagttacggtaccccgatcaccttcggccaagggacacgactggagattaaacga

SEQ ID NO: 1634 - protein, 108 aa, Artificial Sequence
  synthetic
DIQMTQSPSSLSASVGDRVTITCRASQNIRTYLNWYQQKPGKAPKFLIYAASSLRSGVPSRFSGSGSGTDFTLTIGSLQPEDFATYYCHQSYGTPITFGQGTRLEIKR

SEQ ID NO: 1635 - DNA, 18 bp, Artificial Sequence
  synthetic
cagaacattagaacctat

SEQ ID NO: 1636 - protein, 6 aa, Artificial Sequence
  synthetic
QNIRTY

SEQ ID NO: 1637 - DNA, 9 bp, Artificial Sequence
  synthetic
gctgcatcc

SEQ ID NO: 1638 - protein, 3 aa, Artificial Sequence
  synthetic
AAS

SEQ ID NO: 1639 - DNA, 27 bp, Artificial Sequence
  synthetic
caccagagttacggtaccccgatcacc

SEQ ID NO: 1640 - protein, 9 aa, Artificial Sequence
  synthetic
HQSYGTPIT

SEQ ID NO: 1641 - DNA, 363 bp, Artificial Sequence
  synthetic
caggtgcagctggtggagtcgggcccaggactggtgaagccttcggagaccctgtccctcacctgcactgtctctggtggctccatcagtacttactactggaattggatccggcagcccccagggaagggactggaattgattgggtatatctataagagtgggaaaaacaattataatccctccctcaagagtcgcgtcaccataaaagtagacacgtccaagaaccagttgtccctgaacctgagttctgtgaccgctgcggacacggccgtatattattgtgcgagagagggggggggactccctacggggggatattttgactactggggccagggaaccctggtcaccgtctcctca

SEQ ID NO: 1642 - protein, 121 aa, Artificial Sequence
  synthetic
QVQLVESGPGLVKPSETLSLTCTVSGGSISTYYWNWIRQPPGKGLELIGYIYKSGKNNYNPSLKSRVTIKVDTSKNQLSLNLSSVTAADTAVYYCAREGGGLPTGGYFDYWGQGTLVTVSS

SEQ ID NO: 1643 - DNA, 24 bp, Artificial Sequence
  synthetic
ggtggctccatcagtacttactac

SEQ ID NO: 1644 - protein, 8 aa, Artificial Sequence
  synthetic
GGSISTYY

SEQ ID NO: 1645 - DNA, 21 bp, Artificial Sequence
  synthetic
atctataagagtgggaaaaac

SEQ ID NO: 1646 - protein, 7 aa, Artificial Sequence
  synthetic
IYKSGKN

SEQ ID NO: 1647 - DNA, 45 bp, Artificial Sequence
  synthetic
gcgagagagggggggggactccctacggggggatattttgactac

SEQ ID NO: 1648 - protein, 15 aa, Artificial Sequence
  synthetic
AREGGGLPTGGYFDY

SEQ ID NO: 1649 - DNA, 324 bp, Artificial Sequence
  synthetic
gacatccagatgacccagtctccatcctccctgtctgcatctgtaggagacagagtcaccatcacttgccgggcaagtcaaaacattaggagttatttaaattggtatcaactgaaaccaggaaaagcccctaatctcctgatctatgctgcatccaatttgcaaagtggggtcccatcaaggttcagtggcagtggatctgggacaggtttcactctcaccatcagcagtctgcaacctgaagattttgcaacttactcctgtcaacagagttacagtcacccttacacttttggccaggggaccaaggtggagatcaaacga

SEQ ID NO: 1650 - protein, 108 aa, Artificial Sequence
  synthetic
DIQMTQSPSSLSASVGDRVTITCRASQNIRSYLNWYQLKPGKAPNLLIYAASNLQSGVPSRFSGSGSGTGFTLTISSLQPEDFATYSCQQSYSHPYTFGQGTKVEIKR

SEQ ID NO: 1651 - DNA, 18 bp, Artificial Sequence
  synthetic
caaaacattaggagttat

SEQ ID NO: 1652 - protein, 6 aa, Artificial Sequence
  synthetic
QNIRSY

SEQ ID NO: 1653 - DNA, 9 bp, Artificial Sequence
  synthetic
gctgcatcc

SEQ ID NO: 1654 - protein, 3 aa, Artificial Sequence
  synthetic
AAS

SEQ ID NO: 1655 - DNA, 27 bp, Artificial Sequence
  synthetic
caacagagttacagtcacccttacact

SEQ ID NO: 1656 - protein, 9 aa, Artificial Sequence
  synthetic
QQSYSHPYT

SEQ ID NO: 1657 - DNA, 363 bp, Artificial Sequence
  synthetic
caggtgcagctggtggagtcgggcccaggactggtgaagccttcggcgaccctgtccctcacctgcactgtctctggtggctccatcagtagtcactattggagctggatccgtcagtccccaggggagggactggaatggattggatatatcctttccagtgggaggaccaactacaagtcctccctcaggagccgagtcaccatgtcagtagacacgtccaagaaccagttattcctggagctgacctctgtgaccgctgcggacacggccgtatatttctgtgcgagagaggaggggggactccccactgggggctactttgacaactggggccagggaatcctggtcaccgtctcctca

SEQ ID NO: 1658 - protein, 121 aa, Artificial Sequence
  synthetic
QVQLVESGPGLVKPSATLSLTCTVSGGSISSHYWSWIRQSPGEGLEWIGYILSSGRTNYKSSLRSRVTMSVDTSKNQLFLELTSVTAADTAVYFCAREEGGLPTGGYFDNWGQGILVTVSS

SEQ ID NO: 1659 - DNA, 24 bp, Artificial Sequence
  synthetic
ggtggctccatcagtagtcactat

SEQ ID NO: 1660 - protein, 8 aa, Artificial Sequence
  synthetic
GGSISSHY

SEQ ID NO: 1661 - DNA, 21 bp, Artificial Sequence
  synthetic
atcctttccagtgggaggacc

SEQ ID NO: 1662 - protein, 7 aa, Artificial Sequence
  synthetic
ILSSGRT

SEQ ID NO: 1663 - DNA, 45 bp, Artificial Sequence
  synthetic
gcgagagaggaggggggactccccactgggggctactttgacaac

SEQ ID NO: 1664 - protein, 15 aa, Artificial Sequence
  synthetic
AREEGGLPTGGYFDN

SEQ ID NO: 1665 - DNA, 324 bp, Artificial Sequence
  synthetic
gacatcctgatgacccagtctccatcctccctgtctgcatctgttggagacagagtcactatcacttgccgggcaagtcagaacatttatagttatttaaattggtatcagcagaaaccagggaaagcccctcatctcctgatctatgctgcatccagtttgcaaagtggagtcccttcaaggttcagtggcagtggatctgacacagatttcactctcaccatcaccagtctgcagcctgaagattttgcaacttacttctgtcaacagaattacaatatgccttacagttttggccaggggaccaaggtggagatcaaacga

SEQ ID NO: 1666 - protein, 108 aa, Artificial Sequence
  synthetic
DILMTQSPSSLSASVGDRVTITCRASQNIYSYLNWYQQKPGKAPHLLIYAASSLQSGVPSRFSGSGSDTDFTLTITSLQPEDFATYFCQQNYNMPYSFGQGTKVEIKR

SEQ ID NO: 1667 - DNA, 18 bp, Artificial Sequence
  synthetic
cagaacatttatagttat

SEQ ID NO: 1668 - protein, 6 aa, Artificial Sequence
  synthetic
QNIYSY

SEQ ID NO: 1669 - DNA, 9 bp, Artificial Sequence
  synthetic
gctgcatcc

SEQ ID NO: 1670 - protein, 3 aa, Artificial Sequence
  synthetic
AAS

SEQ ID NO: 1671 - DNA, 27 bp, Artificial Sequence
  synthetic
caacagaattacaatatgccttacagt

SEQ ID NO: 1672 - protein, 9 aa, Artificial Sequence
  synthetic
QQNYNMPYS

SEQ ID NO: 1673 - DNA, 363 bp, Artificial Sequence
  synthetic
gaggtgcagctggtggagtcgggcccaggactggtgaagccttcggagaccctgtccctcacctgcactgtctctggtggctccatcagtacttactactggaattggatccggcagcccccagggaagggactggaattgattgggtatatctataagagtggaagaaacttctataatccctccctcaagagtcgagtcagcataacaatagacacgtccacgaaccagttgtcgctgaagttgacctcagtgaccgctgcggacacggccgtgtattactgtgcgagagagggggggggactccctacggggggatactttgactcctggggccagggaaccctggtcaccgtctcctca

SEQ ID NO: 1674 - protein, 121 aa, Artificial Sequence
  synthetic
EVQLVESGPGLVKPSETLSLTCTVSGGSISTYYWNWIRQPPGKGLELIGYIYKSGRNFYNPSLKSRVSITIDTSTNQLSLKLTSVTAADTAVYYCAREGGGLPTGGYFDSWGQGTLVTVSS

SEQ ID NO: 1675 - DNA, 24 bp, Artificial Sequence
  synthetic
ggtggctccatcagtacttactac

SEQ ID NO: 1676 - protein, 8 aa, Artificial Sequence
  synthetic
GGSISTYY

SEQ ID NO: 1677 - DNA, 21 bp, Artificial Sequence
  synthetic
atctataagagtggaagaaac

SEQ ID NO: 1678 - protein, 7 aa, Artificial Sequence
  synthetic
IYKSGRN

SEQ ID NO: 1679 - DNA, 45 bp, Artificial Sequence; identical to SEQ ID NO: 1615
  synthetic

SEQ ID NO: 1680 - protein, 15 aa, Artificial Sequence
  synthetic
AREGGGLPTGGYFDS

SEQ ID NO: 1681 - DNA, 324 bp, Artificial Sequence
  synthetic
gacatcctgatgacccagtctccatcctccctgtctgcatctgtaggagacagagtcaccatcacttgccgggcaagtcaaaacattaggatttatttaaattggtatcaactgaaaccagggaaagcccctaacctcctgatctatgctacatccaatttgcaaagtggggtcccatcaaggttcagtggcagtggatctgggacagatttcactctctccatcagcagtctgcaacctgaagattttgcaacttactcctgtcaacagagttacagtaacccttacacttttggccaggggaccaaggtggagatcaaacga

SEQ ID NO: 1682 - protein, 108 aa, Artificial Sequence
  synthetic
DILMTQSPSSLSASVGDRVTITCRASQNIRIYLNWYQLKPGKAPNLLIYATSNLQSGVPSRFSGSGSGTDFTLSISSLQPEDFATYSCQQSYSNPYTFGQGTKVEIKR

SEQ ID NO: 1683 - DNA, 18 bp, Artificial Sequence
  synthetic
caaaacattaggatttat

SEQ ID NO: 1684 - protein, 6 aa, Artificial Sequence
  synthetic
QNIRIY

SEQ ID NO: 1685 - DNA, 9 bp, Artificial Sequence
  synthetic
gctacatcc

SEQ ID NO: 1686 - protein, 3 aa, Artificial Sequence
  synthetic
ATS

SEQ ID NO: 1687 - DNA, 27 bp, Artificial Sequence
  synthetic
caacagagttacagtaacccttacact

SEQ ID NO: 1688 - protein, 9 aa, Artificial Sequence
  synthetic
QQSYSNPYT

SEQ ID NO: 1689 - DNA, 363 bp, Artificial Sequence
  synthetic
caggtgcagctggtggagtcgggcccaggactggtgaagccttcggagaccctgtccctcacctgcactgtctctggtggctccatcagtacttactactggaattggatccggcagcccccagggaagggactggaattgattggttatatctataagagtggaagaaacttctataatccctccctcatgagtcgagtcaccataacagtagacacgtccacgaaccagttgtcgctgaagttgacctcagtgaccgctgcggacacggccgtgtattactgtgcgagagagggggggggactccctacggggggatactttgactcctggggccagggaatcctggtcaccgtctcctca

SEQ ID NO: 1690 - protein, 121 aa, Artificial Sequence
  synthetic
QVQLVESGPGLVKPSETLSLTCTVSGGSISTYYWNWIRQPPGKGLELIGYIYKSGRNFYNPSLMSRVTITVDTSTNQLSLKLTSVTAADTAVYYCAREGGGLPTGGYFDSWGQGILVTVSS

SEQ ID NO: 1691 - DNA, 24 bp, Artificial Sequence
  synthetic
ggtggctccatcagtacttactac

SEQ ID NO: 1692 - protein, 8 aa, Artificial Sequence
  synthetic
GGSISTYY

SEQ ID NO: 1693 - DNA, 21 bp, Artificial Sequence
  synthetic
atctataagagtggaagaaac

SEQ ID NO: 1694 - protein, 7 aa, Artificial Sequence
  synthetic
IYKSGRN

SEQ ID NO: 1695 - DNA, 45 bp, Artificial Sequence; identical to SEQ ID NO: 1615
  synthetic

SEQ ID NO: 1696 - protein, 15 aa, Artificial Sequence
  synthetic
AREGGGLPTGGYFDS

SEQ ID NO: 1697 - DNA, 324 bp, Artificial Sequence
  synthetic
gacatccagatgacccagtctccatcctccctgtctgcatctgtaggagacagagtcaccatcacttgccgggcaagtcaaaacattaggaattatttaaattggtatcaactgaaaccagggaaagcccctaacctcctgatctatgctacatccaatttgcaaagtggggtcccatcaaggttcagtggcagtggatctgggacagatttcactctctccatcagcagtcttcaacctgaagattttgcaacttactcctgtcaacagagttacagtaacccttacacttttggccaggggaccaaggtggagatcaaacga

SEQ ID NO: 1698 - protein, 108 aa, Artificial Sequence; identical to SEQ ID NO: 1570
  synthetic

SEQ ID NO: 1699 - DNA, 18 bp, Artificial Sequence
  synthetic
caaaacattaggaattat

SEQ ID NO: 1700 - protein, 6 aa, Artificial Sequence
  synthetic
QNIRNY

SEQ ID NO: 1701 - DNA, 9 bp, Artificial Sequence
  synthetic
gctacatcc

SEQ ID NO: 1702 - protein, 3 aa, Artificial Sequence
  synthetic
ATS

SEQ ID NO: 1703 - DNA, 27 bp, Artificial Sequence
  synthetic
caacagagttacagtaacccttacact

SEQ ID NO: 1704 - protein, 9 aa, Artificial Sequence
  synthetic
QQSYSNPYT

SEQ ID NO: 1705 - DNA, 363 bp, Artificial Sequence; identical to SEQ ID NO: 1609
  synthetic

SEQ ID NO: 1706 - protein, 121 aa, Artificial Sequence; identical to SEQ ID NO: 1610
  synthetic

SEQ ID NO: 1707 - DNA, 24 bp, Artificial Sequence
  synthetic
ggtggctccatcagtacttactac

SEQ ID NO: 1708 - protein, 8 aa, Artificial Sequence
  synthetic
GGSISTYY

SEQ ID NO: 1709 - DNA, 21 bp, Artificial Sequence
  synthetic
atctataagagtggaagaaac

SEQ ID NO: 1710 - protein, 7 aa, Artificial Sequence
  synthetic
IYKSGRN

SEQ ID NO: 1711 - DNA, 45 bp, Artificial Sequence; identical to SEQ ID NO: 1615
  synthetic

SEQ ID NO: 1712 - protein, 15 aa, Artificial Sequence
  synthetic
AREGGGLPTGGYFDS

SEQ ID NO: 1713 - DNA, 324 bp, Artificial Sequence
  synthetic
gacatccagatgacccagtctccatcctccctgtctgcatctgtaggagacagagtcaccatcacttgccgggcaagtcaaaacattaggaattatttaaattggtatcaactgaaaccagggaaagcccctaacctcctgatctatgctacatccaatttgcaaaatggggtcccatcaaggttcagtggcagtggatctgggacagatttcactctctccatcagcagtctgcaacctgaagattttgcaacttactcctgtcaacagagttacagtaacccttacacttttggccaggggaccaaggtggagatcaaacga

SEQ ID NO: 1714 - protein, 108 aa, Artificial Sequence
  synthetic
DIQMTQSPSSLSASVGDRVTITCRASQNIRNYLNWYQLKPGKAPNLLIYATSNLQNGVPSRFSGSGSGTDFTLSISSLQPEDFATYSCQQSYSNPYTFGQGTKVEIKR

SEQ ID NO: 1715 - DNA, 18 bp, Artificial Sequence
  synthetic
caaaacattaggaattat

SEQ ID NO: 1716 - protein, 6 aa, Artificial Sequence
  synthetic
QNIRNY

SEQ ID NO: 1717 - DNA, 9 bp, Artificial Sequence
  synthetic
gctacatcc

SEQ ID NO: 1718 - protein, 3 aa, Artificial Sequence
  synthetic
ATS

SEQ ID NO: 1719 - DNA, 27 bp, Artificial Sequence
  synthetic
caacagagttacagtaacccttacact

SEQ ID NO: 1720 - protein, 9 aa, Artificial Sequence
  synthetic
QQSYSNPYT

SEQ ID NO: 1721 - DNA, 363 bp, Artificial Sequence
  synthetic
caggtgcagctggtggagtcgggcccaggactggtgaagccttcggagaccctgtccctcacctgcactgtctctggtggctccatcagtagtcactactggagctggatccggcagcccccagggaagggactggaatggattgggtatatcttttccagtgggaggaccaactacaagtcctccctcaggagtcgagtcaccatgtcagtagacacgtccaagaaccagttatccctgaagctgacctctgtgaccgctgcggacacggccgtatattactgtgcgagagagggggggggactccctactgggggctactttgactactggggccagggaaccacggtcaccgtctcctca

SEQ ID NO: 1722 - protein, 121 aa, Artificial Sequence
  synthetic
QVQLVESGPGLVKPSETLSLTCTVSGGSISSHYWSWIRQPPGKGLEWIGYIFSSGRTNYKSSLRSRVTMSVDTSKNQLSLKLTSVTAADTAVYYCAREGGGLPTGGYFDYWGQGTTVTVSS

SEQ ID NO: 1723 - DNA, 24 bp, Artificial Sequence
  synthetic
ggtggctccatcagtagtcactac

SEQ ID NO: 1724 - protein, 8 aa, Artificial Sequence
  synthetic
GGSISSHY

SEQ ID NO: 1725 - DNA, 21 bp, Artificial Sequence
  synthetic
atcttttccagtgggaggacc

SEQ ID NO: 1726 - protein, 7 aa, Artificial Sequence
  synthetic
IFSSGRT

SEQ ID NO: 1727 - DNA, 45 bp, Artificial Sequence
  synthetic
gcgagagagggggggggactccctactgggggctactttgactac

SEQ ID NO: 1728 - protein, 15 aa, Artificial Sequence
  synthetic
AREGGGLPTGGYFDY

SEQ ID NO: 1729 - DNA, 324 bp, Artificial Sequence
  synthetic
gacatcctgatgacccagtctccatcctccctgtctgcatctgtaggagacagagtcactatcacttgccgggcaagtcagaacatttatagttatttaaattggtatcagcagaaaccagggaaagcccctaatctcctgatctatgctgcatccagtttgcaaagtggggtcccttcaaggttcagtggcagtggatctgggacagatttcactctcaccatcagcagtctgcagcctgaagattttgcaacttacttctgtcaacagaattacaatatgccttacagttttggccaggggaccaaggtggagatcaaacga

SEQ ID NO: 1730 - protein, 108 aa, Artificial Sequence
  synthetic
DILMTQSPSSLSASVGDRVTITCRASQNIYSYLNWYQQKPGKAPNLLIYAASSLQSGVPSRFSGSGSGTDFTLTISSLQPEDFATYFCQQNYNMPYSFGQGTKVEIKR

SEQ ID NO: 1731 - DNA, 18 bp, Artificial Sequence
  synthetic
cagaacatttatagttat

SEQ ID NO: 1732 - protein, 6 aa, Artificial Sequence
  synthetic
QNIYSY

SEQ ID NO: 1733 - DNA, 9 bp, Artificial Sequence
  synthetic
gctgcatcc

SEQ ID NO: 1734 - protein, 3 aa, Artificial Sequence
  synthetic
AAS

SEQ ID NO: 1735 - DNA, 27 bp, Artificial Sequence
  synthetic
caacagaattacaatatgccttacagt

SEQ ID NO: 1736 - protein, 9 aa, Artificial Sequence
  synthetic
QQNYNMPYS

SEQ ID NO: 1737 - DNA, 363 bp, Artificial Sequence
  synthetic
gaggtgcagctggtggagtcgggcccaggactggtgaagccttcggagaccctgtccctcacctgcactgtctctggtggctccatcagcacttattattggaattggatccggcagcccccagggaagggactggaattgattgggtatatctataagagtggaagaaacttctataatccctccctcaagagtcgagtcaccatagcagtagacacgtccacgaaccagttgtcgctgaagttgacctcagtgaccgctgcggacacggccgtgtattactgtgcgagagagggggggggactccctacggggggatactttgactcctggggccagggaaccacggtcaccgtctcctca

SEQ ID NO: 1738 - protein, 121 aa, Artificial Sequence
  synthetic
EVQLVESGPGLVKPSETLSLTCTVSGGSISTYYWNWIRQPPGKGLELIGYIYKSGRNFYNPSLKSRVTIAVDTSTNQLSLKLTSVTAADTAVYYCAREGGGLPTGGYFDSWGQGTTVTVSS

SEQ ID NO: 1739 - DNA, 24 bp, Artificial Sequence
  synthetic
ggtggctccatcagcacttattat

SEQ ID NO: 1740 - protein, 8 aa, Artificial Sequence
  synthetic
GGSISTYY

SEQ ID NO: 1741 - DNA, 21 bp, Artificial Sequence
  synthetic
atctataagagtggaagaaac

SEQ ID NO: 1742 - protein, 7 aa, Artificial Sequence
  synthetic
IYKSGRN

SEQ ID NO: 1743 - DNA, 45 bp, Artificial Sequence; identical to SEQ ID NO: 1615
  synthetic

SEQ ID NO: 1744 - protein, 15 aa, Artificial Sequence
  synthetic
AREGGGLPTGGYFDS

SEQ ID NO: 1745 - DNA, 324 bp, Artificial Sequence
  synthetic
gacatccagatgacccagtctccatcctccctgtctgcatctgtaggagacagagtcaccatcacttgccgggcaagtcaaaacattaggaattatttaaattggtatcaactgaaaccagggaaagcccctaacctcctgatctatgctacatccaatttgcaaagtgaggtcccatcaagattcagtggcagtggatctgggacagatttcactctctccatcagcagtctgcaacctgaagattttgcaacttactcctgtcaacagagttacagtaacccttacacttttggccaggggaccaaggtggagatcaaacga

SEQ ID NO: 1746 - protein, 108 aa, Artificial Sequence
  synthetic
DIQMTQSPSSLSASVGDRVTITCRASQNIRNYLNWYQLKPGKAPNLLIYATSNLQSEVPSRFSGSGSGTDFTLSISSLQPEDFATYSCQQSYSNPYTFGQGTKVEIKR

SEQ ID NO: 1747 - DNA, 18 bp, Artificial Sequence
  synthetic
caaaacattaggaattat

SEQ ID NO: 1748 - protein, 6 aa, Artificial Sequence
  synthetic
QNIRNY

SEQ ID NO: 1749 - DNA, 9 bp, Artificial Sequence
  synthetic
gctacatcc

SEQ ID NO: 1750 - protein, 3 aa, Artificial Sequence
  synthetic
ATS

SEQ ID NO: 1751 - DNA, 27 bp, Artificial Sequence
  synthetic
caacagagttacagtaacccttacact

SEQ ID NO: 1752 - protein, 9 aa, Artificial Sequence
  synthetic
QQSYSNPYT

SEQ ID NO: 1753 - DNA, 363 bp, Artificial Sequence
  synthetic
gaggtgcagctggtggagtcgggcccaggactggtgaagccttcggagaccctgtccctcacctgcactgtctctggtggctccatcagtacttactactggaattggatccggcaggccccagggaagggactggaattgattgggtatatctataagagtggaagaaagttctataatccctccctcaagagtcgaggcaccatagcagtagacacgtccacgaaccagttgtcgctgaagttgacctcagtgaccgctgcggacacggccgtgtattactgtgcgagagagggggggggactccctacggggggatactttgactcctggggccagggaaccctggtcaccgtctcctca

SEQ ID NO: 1754 - protein, 121 aa, Artificial Sequence
  synthetic
EVQLVESGPGLVKPSETLSLTCTVSGGSISTYYWNWIRQAPGKGLELIGYIYKSGRKFYNPSLKSRGTIAVDTSTNQLSLKLTSVTAADTAVYYCAREGGGLPTGGYFDSWGQGTLVTVSS

SEQ ID NO: 1755 - DNA, 24 bp, Artificial Sequence
  synthetic
ggtggctccatcagtacttactac

SEQ ID NO: 1756 - protein, 8 aa, Artificial Sequence
  synthetic
GGSISTYY

SEQ ID NO: 1757 - DNA, 21 bp, Artificial Sequence
  synthetic
atctataagagtggaagaaag

SEQ ID NO: 1758 - protein, 7 aa, Artificial Sequence
  synthetic
IYKSGRK

SEQ ID NO: 1759 - DNA, 45 bp, Artificial Sequence; identical to SEQ ID NO: 1615
  synthetic

SEQ ID NO: 1760 - protein, 15 aa, Artificial Sequence
  synthetic
AREGGGLPTGGYFDS

SEQ ID NO: 1761 - DNA, 324 bp, Artificial Sequence
  synthetic
gacatccagatgacccagtctccatcctccctgtctgcatctgtaggagacagagtcaccatcacttgccgggcaagtcaaaacattaggaattatttaaattggtatcaactgaaaccagggaaagcccctaacctcctgatctatgctacatccaatttgcaaagtggggtcccatcaagattcagtggcagtggatctgggacagatttcactctctccatcagcagtctgcaacctgaagattttgcaacttactgctgtcaacagagttacagtaacccttacacttttggccaggggaccaaggtggagatcaaacga

SEQ ID NO: 1762 - protein, 108 aa, Artificial Sequence
  synthetic
DIQMTQSPSSLSASVGDRVTITCRASQNIRNYLNWYQLKPGKAPNLLIYATSNLQSGVPSRFSGSGSGTDFTLSISSLQPEDFATYCCQQSYSNPYTFGQGTKVEIKR

SEQ ID NO: 1763 - DNA, 18 bp, Artificial Sequence
  synthetic
caaaacattaggaattat

SEQ ID NO: 1764 - protein, 6 aa, Artificial Sequence
  synthetic
QNIRNY

SEQ ID NO: 1765 - DNA, 9 bp, Artificial Sequence
  synthetic
gctacatcc

SEQ ID NO: 1766 - protein, 3 aa, Artificial Sequence
  synthetic
ATS

SEQ ID NO: 1767 - DNA, 27 bp, Artificial Sequence
  synthetic
caacagagttacagtaacccttacact

SEQ ID NO: 1768 - protein, 9 aa, Artificial Sequence
  synthetic
QQSYSNPYT

SEQ ID NO: 1769 - DNA, 363 bp, Artificial Sequence
  synthetic
gaggtgcagctggtggagtcgggcccaggactggtgaagccttcggagaccctgtccctcacctgcactgtctctggtgtctccatcagtagtcactactggaactggatccggcagcccccaggggagggcctggaatggattggatatatcttctctactaggaggaccaactacaagtcctccctcaggagtcgagtcaccatgtcagtagacacgtccaagaaccagttatccctgaagctgacctctgtgaccgctgcggacacggccgtatattactgtgcgagagaggaggggggactccctactgggggctattttgactactggggccagggaaccctggtcaccgtctcctca

SEQ ID NO: 1770 - protein, 121 aa, Artificial Sequence
  synthetic
EVQLVESGPGLVKPSETLSLTCTVSGVSISSHYWNWIRQPPGEGLEWIGYIFSTRRTNYKSSLRSRVTMSVDTSKNQLSLKLTSVTAADTAVYYCAREEGGLPTGGYFDYWGQGTLVTVSS

SEQ ID NO: 1771 - DNA, 24 bp, Artificial Sequence
  synthetic
ggtgtctccatcagtagtcactac

SEQ ID NO: 1772 - protein, 8 aa, Artificial Sequence
  synthetic
GVSISSHY

SEQ ID NO: 1773 - DNA, 21 bp, Artificial Sequence
  synthetic
atcttctctactaggaggacc

SEQ ID NO: 1774 - protein, 7 aa, Artificial Sequence
  synthetic
IFSTRRT

SEQ ID NO: 1775 - DNA, 45 bp, Artificial Sequence
  synthetic
gcgagagaggaggggggactccctactgggggctattttgactac

SEQ ID NO: 1776 - protein, 15 aa, Artificial Sequence
  synthetic
AREEGGLPTGGYFDY

SEQ ID NO: 1777 - DNA, 324 bp, Artificial Sequence
  synthetic
gacatccagatgacccagtctccatcctccctgtctgcgtctgtaggagacagagtcactatcacttgccggccaagtcagaacatttatagttatttaaattggtatcagcagaaaccagggaaagcccctaatctcctgatctatactgcatccagtttgcaaagcggggtctcttcaaggttcagtggcagtggatctgggacagatttcactctcaccatcaccagtctgcagcctgaagattttgcaacttacttctgtcaacagaattacaatatgccttacagttttggccaggggaccaaggtggagatcaaacga

SEQ ID NO: 1778 - protein, 108 aa, Artificial Sequence
  synthetic
DIQMTQSPSSLSASVGDRVTITCRPSQNIYSYLNWYQQKPGKAPNLLIYTASSLQSGVSSRFSGSGSGTDFTLTITSLQPEDFATYFCQQNYNMPYSFGQGTKVEIKR

SEQ ID NO: 1779 - DNA, 18 bp, Artificial Sequence
  synthetic
cagaacatttatagttat

SEQ ID NO: 1780 - protein, 6 aa, Artificial Sequence
  synthetic
QNIYSY

SEQ ID NO: 1781 - DNA, 9 bp, Artificial Sequence
  synthetic
actgcatcc

SEQ ID NO: 1782 - protein, 3 aa, Artificial Sequence
  synthetic
TAS

SEQ ID NO: 1783 - DNA, 27 bp, Artificial Sequence
  synthetic
caacagaattacaatatgccttacagt

SEQ ID NO: 1784 - protein, 9 aa, Artificial Sequence
  synthetic
QQNYNMPYS

SEQ ID NO: 1785 - DNA, 378 bp, Artificial Sequence
  synthetic
gaggtgcagctggtggagtcgggcccaggactggtgaagccttcggagaccctgtccctcacctgcactgtctctggtggctccatcagcagtggtggttactactggagctggatccgtcagcacccagggaagggcctggagtggattgggtacatctattacagtgggaacacctactacaacccgtccctcaagagtcgagttaccatatcaatagacacgtctaagaaccagttctccctgaagctgaactctgtgactgccgcggacacggccgtctattactgtgcgcgaggagttataggaactatgattatagcagcagctatcccttttgactactggggccagggaaccatggtcaccgtctcctca

SEQ ID NO: 1786 - protein, 126 aa, Artificial Sequence
  synthetic
EVQLVESGPGLVKPSETLSLTCTVSGGSISSGGYYWSWIRQHPGKGLEWIGYIYYSGNTYYNPSLKSRVTISIDTSKNQFSLKLNSVTAADTAVYYCARGVIGTMIIAAAIPFDYWGQGTMVTVSS

SEQ ID NO: 1787 - DNA, 30 bp, Artificial Sequence
  synthetic
ggtggctccatcagcagtggtggttactac

SEQ ID NO: 1788 - protein, 10 aa, Artificial Sequence
  synthetic
GGSISSGGYY

SEQ ID NO: 1789 - DNA, 21 bp, Artificial Sequence
  synthetic
atctattacagtgggaacacc

SEQ ID NO: 1790 - protein, 7 aa, Artificial Sequence
  synthetic
IYYSGNT

SEQ ID NO: 1791 - DNA, 54 bp, Artificial Sequence
  synthetic
gcgcgaggagttataggaactatgattatagcagcagctatcccttttgactac

SEQ ID NO: 1792 - protein, 18 aa, Artificial Sequence
  synthetic
ARGVIGTMIIAAAIPFDY

SEQ ID NO: 1793 - DNA, 324 bp, Artificial Sequence
  synthetic
gacatccagatgacccagtctccatcctccctgtctgcatctgtaggagacagagtcaccatcacttgccgggcaagtcaaaacattaggaattatttaaattggtatcaactgaaaccagggaaagcccctaacctcctgatctatgctacatccaatttgcaaagtggggtcccatcaaggttcagtggcagtggatctgggacagatttcactctctccatcagcagtctgcagcctgcagattttgcaacttactcctgtcagcagagttacagtaacccttacacttttggccaggggaccaaggtggagatcaaacga

SEQ ID NO: 1794 - protein, 108 aa, Artificial Sequence
  synthetic
DIQMTQSPSSLSASVGDRVTITCRASQNIRNYLNWYQLKPGKAPNLLIYATSNLQSGVPSRFSGSGSGTDFTLSISSLQPADFATYSCQQSYSNPYTFGQGTKVEIKR

SEQ ID NO: 1795 - DNA, 18 bp, Artificial Sequence
  synthetic
caaaacattaggaattat

SEQ ID NO: 1796 - protein, 6 aa, Artificial Sequence
  synthetic
QNIRNY

SEQ ID NO: 1797 - DNA, 9 bp, Artificial Sequence
  synthetic
gctacatcc

SEQ ID NO: 1798 - protein, 3 aa, Artificial Sequence
  synthetic
ATS

SEQ ID NO: 1799 - DNA, 27 bp, Artificial Sequence
  synthetic
cagcagagttacagtaacccttacact

SEQ ID NO: 1800 - protein, 9 aa, Artificial Sequence
  synthetic
QQSYSNPYT

SEQ ID NO: 1801 - DNA, 375 bp, Artificial Sequence
  synthetic
caggtgcagctggtggagtcgggcccaggactggtgaggccttcggagaccctgtccctcacctgcactgtctctggtgcctccatcagtaattactactggagctggatccgacagaccccagggaagggactggagtggattggatatttccattatagtgggagaaccaactacaacccctccctcaagagtcgagtttctatatcagtggacacgtccaagaatcagttctccctgaacctgaactttgtgagcgccgcagacacggccgtttattactgtgcgcgggactccaaggtcattgcagcaatcccaagtgctcactggtatttcgatccctggggccgtggcacactggtcaccgtctcctca

SEQ ID NO: 1802 - protein, 125 aa, Artificial Sequence
  synthetic
QVQLVESGPGLVRPSETLSLTCTVSGASISNYYWSWIRQTPGKGLEWIGYFHYSGRTNYNPSLKSRVSISVDTSKNQFSLNLNFVSAADTAVYYCARDSKVIAAIPSAHWYFDPWGRGTLVTVSS

SEQ ID NO: 1803 - DNA, 24 bp, Artificial Sequence
  synthetic
ggtgcctccatcagtaattactac

SEQ ID NO: 1804 - protein, 8 aa, Artificial Sequence
  synthetic
GASISNYY

SEQ ID NO: 1805 - DNA, 21 bp, Artificial Sequence
  synthetic
ttccattatagtgggagaacc

SEQ ID NO: 1806 - protein, 7 aa, Artificial Sequence
  synthetic
FHYSGRT

SEQ ID NO: 1807 - DNA, 57 bp, Artificial Sequence; identical to SEQ ID NO: 1455
  synthetic

SEQ ID NO: 1808 - protein, 19 aa, Artificial Sequence
  synthetic
ARDSKVIAAIPSAHWYFDP

SEQ ID NO: 1809 - DNA, 324 bp, Artificial Sequence; identical to SEQ ID NO: 1633
  synthetic

SEQ ID NO: 1810 - protein, 108 aa, Artificial Sequence; identical to SEQ ID NO: 1634
  synthetic

SEQ ID NO: 1811 - DNA, 18 bp, Artificial Sequence
  synthetic
cagaacattagaacctat

SEQ ID NO: 1812 - protein, 6 aa, Artificial Sequence
  synthetic
QNIRTY

SEQ ID NO: 1813 - DNA, 9 bp, Artificial Sequence
  synthetic
gctgcatcc

SEQ ID NO: 1814 - protein, 3 aa, Artificial Sequence
  synthetic
AAS

SEQ ID NO: 1815 - DNA, 27 bp, Artificial Sequence
  synthetic
caccagagttacggtaccccgatcacc

SEQ ID NO: 1816 - protein, 9 aa, Artificial Sequence
  synthetic
HQSYGTPIT

SEQ ID NO: 1817 - DNA, 363 bp, Artificial Sequence
  synthetic
gaggtgcagctggtggagtcgggcccaggactggtgaagccttcggagaccctgtccctcacctgcactgtctctggtggctccatcagtagtcactattggagctggatccgtcagcccccaggggagggactggaatggattggatatatcctttccagtgggaggaccaactacaagtcctccctcaggacccgagtcaccatgtcagtagacacgtccaagaaccagttattcctggagctgacctctgtgaccgctgcggacacggccgtatatttctgtgcgagagaggaggggggactccccactgggggctactttgacaactggggccagggaatcctggtcaccgtctcctca

SEQ ID NO: 1818 - protein, 121 aa, Artificial Sequence
  synthetic
EVQLVESGPGLVKPSETLSLTCTVSGGSISSHYWSWIRQPPGEGLEWIGYILSSGRTNYKSSLRTRVTMSVDTSKNQLFLELTSVTAADTAVYFCAREEGGLPTGGYFDNWGQGILVTVSS

SEQ ID NO: 1819 - DNA, 24 bp, Artificial Sequence
  synthetic
ggtggctccatcagtagtcactat

SEQ ID NO: 1820 - protein, 8 aa, Artificial Sequence
  synthetic
GGSISSHY

SEQ ID NO: 1821 - DNA, 21 bp, Artificial Sequence
  synthetic
atcctttccagtgggaggacc

SEQ ID NO: 1822 - protein, 7 aa, Artificial Sequence
  synthetic
ILSSGRT

SEQ ID NO: 1823 - DNA, 45 bp, Artificial Sequence; identical to SEQ ID NO: 1663
  synthetic

SEQ ID NO: 1824 - protein, 15 aa, Artificial Sequence
  synthetic
AREEGGLPTGGYFDN

SEQ ID NO: 1825 - DNA, 324 bp, Artificial Sequence
  synthetic
gacatcctgatgacccagtctccatcctccctgtctgcatctgtaggagacagagtcactatcacttgccgggcaagtcagaacatttatagttatttaaattggtatcagcagaaaccagggaaagcccctcatctcctgatctatgctgcatccagtttgcaaagtggagtcccttcaaggttcagtggcagtggatctgacacagatttcactctcaccatcaccagtctgcagcctgaagattttgctacttacttctgtcaacagaattacaatatgccttacagttttggccaggggaccaaggtggagatcaaacga

SEQ ID NO: 1826 - protein, 108 aa, Artificial Sequence; identical to SEQ ID NO: 1666
  synthetic

SEQ ID NO: 1827 - DNA, 18 bp, Artificial Sequence
  synthetic
cagaacatttatagttat

SEQ ID NO: 1828 - protein, 6 aa, Artificial Sequence
  synthetic
QNIYSY

SEQ ID NO: 1829 - DNA, 9 bp, Artificial Sequence
  synthetic
gctgcatcc

SEQ ID NO: 1830 - protein, 3 aa, Artificial Sequence
  synthetic
AAS

SEQ ID NO: 1831 - DNA, 27 bp, Artificial Sequence
  synthetic
caacagaattacaatatgccttacagt

SEQ ID NO: 1832 - protein, 9 aa, Artificial Sequence
  synthetic
QQNYNMPYS

SEQ ID NO: 1833 - DNA, 360 bp, Artificial Sequence
  synthetic
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgaggaccgggtatagcagcagccgtccatttgactactggggccagggaaccctggtcaccgtctcctca

SEQ ID NO: 1834 - protein, 120 aa, Artificial Sequence
  synthetic
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARTGYSSSRPFDYWGQGTLVTVSS

SEQ ID NO: 1835 - DNA, 24 bp, Artificial Sequence
  synthetic
ggattcaccttcagtagttatgaa

SEQ ID NO: 1836 - protein, 8 aa, Artificial Sequence
  synthetic
GFTFSSYE

SEQ ID NO: 1837 - DNA, 24 bp, Artificial Sequence
  synthetic
attagtagtagtggtagtaccata

SEQ ID NO: 1838 - protein, 8 aa, Artificial Sequence
  synthetic
ISSSGSTI

SEQ ID NO: 1839 - DNA, 39 bp, Artificial Sequence
  synthetic
gcgaggaccgggtatagcagcagccgtccatttgactac

SEQ ID NO: 1840 - protein, 13 aa, Artificial Sequence
  synthetic
ARTGYSSSRPFDY

SEQ ID NO: 1841 - DNA, 327 bp, Artificial Sequence
  synthetic
gacatccagatgacccagtctccatcctccctgtctgcatctgtaggagacagagtcaccatcacttgccaggcgagtcaggacattagcaactatttaaattggtatcagcagaaaccagggaaagcccctaacctcctgatctatgctacatccaatttgcaaagtggggtcccatcaaggttcagtggcagtggatctgggacagattttactttcaccatcagcagcctgcagcctgaagattttgcaacttattactgtcaacagtatgataatctccctccgctcactttcggcggagggaccaaggtggagatcaaacga

SEQ ID NO: 1842 - protein, 109 aa, Artificial Sequence
  synthetic
DIQMTQSPSSLSASVGDRVTITCQASQDISNYLNWYQQKPGKAPNLLIYATSNLQSGVPSRFSGSGSGTDFTFTISSLQPEDFATYYCQQYDNLPPLTFGGGTKVEIKR

SEQ ID NO: 1843 - DNA, 18 bp, Artificial Sequence
  synthetic
caggacattagcaactat

SEQ ID NO: 1844 - protein, 6 aa, Artificial Sequence
  synthetic
QDISNY

SEQ ID NO: 1845 - DNA, 9 bp, Artificial Sequence
  synthetic
gctacatcc

SEQ ID NO: 1846 - protein, 3 aa, Artificial Sequence
  synthetic
ATS

SEQ ID NO: 1847 - DNA, 30 bp, Artificial Sequence
  synthetic
caacagtatgataatctccctccgctcact

SEQ ID NO: 1848 - protein, 10 aa, Artificial Sequence
  synthetic
QQYDNLPPLT

SEQ ID NO: 1849 - DNA, 363 bp, Artificial Sequence
  synthetic
caggtgcagctggtggagtcgggcccaggactggtgaagccttcggagaccctgtccctcacctgcactgtcgctggtggctccatcagtacttactactggaattggatccggcagcccccagggaagggactggaattgattgggtatatctataagagtggaagaaacttctataatccctccctcaagagtcgagtcaccatagcagtagacacgtccacgaaccagttgtcgctgaagttgacctcagtgaccgctgcggacacggccgtgtattattgtgtgagagagggggggggactccctacggggggatactttgactcctggggccagggaaccctggtcaccgtctcctca

SEQ ID NO: 1850 - protein, 121 aa, Artificial Sequence
  synthetic
QVQLVESGPGLVKPSETLSLTCTVAGGSISTYYWNWIRQPPGKGLELIGYIYKSGRNFYNPSLKSRVTIAVDTSTNQLSLKLTSVTAADTAVYYCVREGGGLPTGGYFDSWGQGTLVTVSS

SEQ ID NO: 1851 - DNA, 24 bp, Artificial Sequence
  synthetic
ggtggctccatcagtacttactac

SEQ ID NO: 1852 - protein, 8 aa, Artificial Sequence
  synthetic
GGSISTYY

SEQ ID NO: 1853 - DNA, 21 bp, Artificial Sequence
  synthetic
atctataagagtggaagaaac

SEQ ID NO: 1854 - protein, 7 aa, Artificial Sequence
  synthetic
IYKSGRN

SEQ ID NO: 1855 - DNA, 45 bp, Artificial Sequence; identical to SEQ ID NO: 1503
  synthetic

SEQ ID NO: 1856 - protein, 15 aa, Artificial Sequence
  synthetic
VREGGGLPTGGYFDS

SEQ ID NO: 1857 - DNA, 324 bp, Artificial Sequence; identical to SEQ ID NO: 1569
  synthetic

SEQ ID NO: 1858 - protein, 108 aa, Artificial Sequence; identical to SEQ ID NO: 1570
  synthetic

SEQ ID NO: 1859 - DNA, 18 bp, Artificial Sequence
  synthetic
caaaacattaggaattat

SEQ ID NO: 1860 - protein, 6 aa, Artificial Sequence
  synthetic
QNIRNY

SEQ ID NO: 1861 - DNA, 9 bp, Artificial Sequence
  synthetic
gctacatcc

SEQ ID NO: 1862 - protein, 3 aa, Artificial Sequence
  synthetic
ATS

SEQ ID NO: 1863 - DNA, 27 bp, Artificial Sequence
  synthetic
caacagagttacagtaacccttacact

SEQ ID NO: 1864 - protein, 9 aa, Artificial Sequence
  synthetic
QQSYSNPYT

SEQ ID NO: 1865 - DNA, 363 bp, Artificial Sequence
  synthetic
gaggtgcagctggtggagtcgggcccaggactggtgaagccttcggagaccctgtccctcacctgcactgtctctggtggctccatcagtacttactactggaattggatccggcagtccccagggaagggactggaattgattgggtatatctataagagtgggaaaaacaattataatccctccctcaagagtcgcgtcaccataaaagtagacacgtccaagaaccagttgtccctgaacctgaggtctgtgaccgctgcggacacggccgtgtattattgtgcgagagagggggggggactccctacggggggatattttgactactggggccagggaaccccggtcaccgtctcctca

SEQ ID NO: 1866 - protein, 121 aa, Artificial Sequence
  synthetic
EVQLVESGPGLVKPSETLSLTCTVSGGSISTYYWNWIRQSPGKGLELIGYIYKSGKNNYNPSLKSRVTIKVDTSKNQLSLNLRSVTAADTAVYYCAREGGGLPTGGYFDYWGQGTPVTVSS

SEQ ID NO: 1867 - DNA, 24 bp, Artificial Sequence
  synthetic
ggtggctccatcagtacttactac

SEQ ID NO: 1868 - protein, 8 aa, Artificial Sequence
  synthetic
GGSISTYY

SEQ ID NO: 1869 - DNA, 21 bp, Artificial Sequence
  synthetic
atctataagagtgggaaaaac

SEQ ID NO: 1870 - protein, 7 aa, Artificial Sequence
  synthetic
IYKSGKN

SEQ ID NO: 1871 - DNA, 45 bp, Artificial Sequence; identical to SEQ ID NO: 1647
  synthetic

SEQ ID NO: 1872 - protein, 15 aa, Artificial Sequence
  synthetic
AREGGGLPTGGYFDY

SEQ ID NO: 1873 - DNA, 324 bp, Artificial Sequence
  synthetic
gacatcctgatgacccagtctccatcctccctgtctgcatctgtaggagacagagtcaccatcacttgccgggcaagtcaaaacattaggagttatttaaattggtatcaactgaaaccaggaaaagcccctaatctcctgatctatgctgcatccaatttgcaaagtggggtcccatcaaggttcagtggcagtggatctgggacagatttcactctcaccatcagcagtctgcaacctgaagattttgcaacttactcctgtcaacagagttacagtcacccttacacttttggccaggggaccaaggtggagatcaaacga

SEQ ID NO: 1874 - protein, 108 aa, Artificial Sequence
  synthetic
DILMTQSPSSLSASVGDRVTITCRASQNIRSYLNWYQLKPGKAPNLLIYAASNLQSGVPSRFSGSGSGTDFTLTISSLQPEDFATYSCQQSYSHPYTFGQGTKVEIKR

SEQ ID NO: 1875 - DNA, 18 bp, Artificial Sequence
  synthetic
caaaacattaggagttat

SEQ ID NO: 1876 - protein, 6 aa, Artificial Sequence
  synthetic
QNIRSY

SEQ ID NO: 1877 - DNA, 9 bp, Artificial Sequence
  synthetic
gctgcatcc

SEQ ID NO: 1878 - protein, 3 aa, Artificial Sequence
  synthetic
AAS

SEQ ID NO: 1879 - DNA, 27 bp, Artificial Sequence
  synthetic
caacagagttacagtcacccttacact

SEQ ID NO: 1880 - protein, 9 aa, Artificial Sequence
  synthetic
QQSYSHPYT

SEQ ID NO: 1881 - DNA, 375 bp, Artificial Sequence
  synthetic
gaggtgcagctggtggagtcgggcccaggactggtgaggccttcggagaccctgtccctcacctgcactgtctctggtgcctccatcagtaattactactggagctggatccgacagaccccagggaagggactggagtggattggatatttccattatagtgggagaaccaactacaacccctccctcaagagtcgagtttctatatcagtggacacgtccaagaatcagttctccctgaacctgaactttgtgagcgccgcagacacggccgtttattactgtgcgcgggactccaaggtcattgcagcaatcccaagtgctcactggtatttcgatccctggggccgtggcacactggtcaccgtctcctca

SEQ ID NO: 1882 - protein, 125 aa, Artificial Sequence
  synthetic
EVQLVESGPGLVRPSETLSLTCTVSGASISNYYWSWIRQTPGKGLEWIGYFHYSGRTNYNPSLKSRVSISVDTSKNQFSLNLNFVSAADTAVYYCARDSKVIAAIPSAHWYFDPWGRGTLVTVSS

SEQ ID NO: 1883 - DNA, 24 bp, Artificial Sequence
  synthetic
ggtgcctccatcagtaattactac

SEQ ID NO: 1884 - protein, 8 aa, Artificial Sequence
  synthetic
GASISNYY

SEQ ID NO: 1885 - DNA, 21 bp, Artificial Sequence
  synthetic
ttccattatagtgggagaacc

SEQ ID NO: 1886 - protein, 7 aa, Artificial Sequence
  synthetic
FHYSGRT

SEQ ID NO: 1887 - DNA, 57 bp, Artificial Sequence; identical to SEQ ID NO: 1455
  synthetic

SEQ ID NO: 1888 - protein, 19 aa, Artificial Sequence
  synthetic
ARDSKVIAAIPSAHWYFDP

SEQ ID NO: 1889 - DNA, 324 bp, Artificial Sequence; identical to SEQ ID NO: 1457
  synthetic

SEQ ID NO: 1890 - protein, 108 aa, Artificial Sequence; identical to SEQ ID NO: 1458
  synthetic

SEQ ID NO: 1891 - DNA, 18 bp, Artificial Sequence
  synthetic
cagaacattagaacctat

SEQ ID NO: 1892 - protein, 6 aa, Artificial Sequence
  synthetic
QNIRTY

SEQ ID NO: 1893 - DNA, 9 bp, Artificial Sequence
  synthetic
gctgcatcc

SEQ ID NO: 1894 - protein, 3 aa, Artificial Sequence
  synthetic
AAS

SEQ ID NO: 1895 - DNA, 27 bp, Artificial Sequence
  synthetic
caccagagttacggtaccccgatcacc

SEQ ID NO: 1896 - protein, 9 aa, Artificial Sequence
  synthetic
HQSYGTPIT

SEQ ID NO: 1897 - DNA, 363 bp, Artificial Sequence; identical to SEQ ID NO: 1753
  synthetic

SEQ ID NO: 1898 - protein, 121 aa, Artificial Sequence; identical to SEQ ID NO: 1754
  synthetic

SEQ ID NO: 1899 - DNA, 24 bp, Artificial Sequence
  synthetic
ggtggctccatcagtacttactac

SEQ ID NO: 1900 - protein, 8 aa, Artificial Sequence
  synthetic
GGSISTYY

SEQ ID NO: 1901 - DNA, 21 bp, Artificial Sequence
  synthetic
atctataagagtggaagaaag

SEQ ID NO: 1902 - protein, 7 aa, Artificial Sequence
  synthetic
IYKSGRK

SEQ ID NO: 1903 - DNA, 45 bp, Artificial Sequence; identical to SEQ ID NO: 1615
  synthetic

SEQ ID NO: 1904 - protein, 15 aa, Artificial Sequence
  synthetic
AREGGGLPTGGYFDS

SEQ ID NO: 1905 - DNA, 324 bp, Artificial Sequence
  synthetic
gacatcctgatgacccagtctccatcctccctgtctgcatctgtaggagacagagtcaccatcacttgccgggcaagtcaaaacattaggaattatttaaattggtatcaactgaaaccagggaaagcccctaacctcctgatctatgctacatccaatttgcaaagtggggtcccatcaagattcagtggcagtggatctgggacagatttcactctctccatcagcagtctgcaacctgaagattttgcaacttactgctgtcaacagagttacagtaacccttacacttttggccaggggaccaaggtggagatcaaacga

SEQ ID NO: 1906 - protein, 108 aa, Artificial Sequence
  synthetic
DILMTQSPSSLSASVGDRVTITCRASQNIRNYLNWYQLKPGKAPNLLIYATSNLQSGVPSRFSGSGSGTDFTLSISSLQPEDFATYCCQQSYSNPYTFGQGTKVEIKR

SEQ ID NO: 1907 - DNA, 18 bp, Artificial Sequence
  synthetic
caaaacattaggaattat

SEQ ID NO: 1908 - protein, 6 aa, Artificial Sequence
  synthetic
QNIRNY

SEQ ID NO: 1909 - DNA, 9 bp, Artificial Sequence
  synthetic
gctacatcc

SEQ ID NO: 1910 - protein, 3 aa, Artificial Sequence
  synthetic
ATS

SEQ ID NO: 1911 - DNA, 27 bp, Artificial Sequence
  synthetic
caacagagttacagtaacccttacact

SEQ ID NO: 1912 - protein, 9 aa, Artificial Sequence
  synthetic
QQSYSNPYT

SEQ ID NO: 1913 - DNA, 363 bp, Artificial Sequence
  synthetic
caggtgcagctggtggagtcgggcccaggactggtgaagccttcggagaccctgtccctcacctgcactgtctctggtggctccatcagcacttattattggaattggatccggcagcccccagggaagggactggaattgattgggtatatctataagagtggaagaaacttctataatccctccctcaagagtcgagtcaccatagcagtagacacgtccacgaaccagttgtcgctgaagttgacctcagtgaccgctgcggacacggccgtgtattactgtgcgagagagggggggggactccctacggggggatactttgactcctggggccagggaaccctggtcaccgtctcctca

SEQ ID NO: 1914 - protein, 121 aa, Artificial Sequence
  synthetic
QVQLVESGPGLVKPSETLSLTCTVSGGSISTYYWNWIRQPPGKGLELIGYIYKSGRNFYNPSLKSRVTIAVDTSTNQLSLKLTSVTAADTAVYYCAREGGGLPTGGYFDSWGQGTLVTVSS

SEQ ID NO: 1915 - DNA, 24 bp, Artificial Sequence
  synthetic
ggtggctccatcagcacttattat

SEQ ID NO: 1916 - protein, 8 aa, Artificial Sequence
  synthetic
GGSISTYY

SEQ ID NO: 1917 - DNA, 21 bp, Artificial Sequence
  synthetic
atctataagagtggaagaaac

SEQ ID NO: 1918 - protein, 7 aa, Artificial Sequence
  synthetic
IYKSGRN

SEQ ID NO: 1919 - DNA, 45 bp, Artificial Sequence; identical to SEQ ID NO: 1615
  synthetic

SEQ ID NO: 1920 - protein, 15 aa, Artificial Sequence
  synthetic
AREGGGLPTGGYFDS

SEQ ID NO: 1921 - DNA, 324 bp, Artificial Sequence; identical to SEQ ID NO: 1745
  synthetic

SEQ ID NO: 1922 - protein, 108 aa, Artificial Sequence; identical to SEQ ID NO: 1746
  synthetic

SEQ ID NO: 1923 - DNA, 18 bp, Artificial Sequence
  synthetic
caaaacattaggaattat

SEQ ID NO: 1924 - protein, 6 aa, Artificial Sequence
  synthetic
QNIRNY

SEQ ID NO: 1925 - DNA, 9 bp, Artificial Sequence
  synthetic
gctacatcc

SEQ ID NO: 1926 - protein, 3 aa, Artificial Sequence
  synthetic
ATS

SEQ ID NO: 1927 - DNA, 27 bp, Artificial Sequence
  synthetic
caacagagttacagtaacccttacact

SEQ ID NO: 1928 - protein, 9 aa, Artificial Sequence
  synthetic
QQSYSNPYT

SEQ ID NO: 1929 - DNA, 366 bp, Artificial Sequence
  synthetic
caggtgcagctggtgcagtggggcgcaggactgttgaagccttcggagaccctgtccctcacctgcgctgtcaacggtgggtccttcaattattaccactggacctggatccgccagcccccagggaaggggctggaatggattggggaaatcaatcatactggaagcaccaactataatccgtccctcaagagtcgagtcaccatatcagttgacacgtccaagaaccagttctccctgaggctgaggtctgtgaccgccgcggacacggctgtgtattactgtgcgagaggccctacttcggtgactacggactactacggtatggacgtctggggccaagggaccacggtcaccgtctcctca

SEQ ID NO: 1930 - protein, 122 aa, Artificial Sequence
  synthetic
QVQLVQWGAGLLKPSETLSLTCAVNGGSFNYYHWTWIRQPPGKGLEWIGEINHTGSTNYNPSLKSRVTISVDTSKNQFSLRLRSVTAADTAVYYCARGPTSVTTDYYGMDVWGQGTTVTVSS

SEQ ID NO: 1931 - DNA, 24 bp, Artificial Sequence
  synthetic
ggtgggtccttcaattattaccac

SEQ ID NO: 1932 - protein, 8 aa, Artificial Sequence
  synthetic
GGSFNYYH

SEQ ID NO: 1933 - DNA, 21 bp, Artificial Sequence
  synthetic
atcaatcatactggaagcacc

SEQ ID NO: 1934 - protein, 7 aa, Artificial Sequence
  synthetic
INHTGST

SEQ ID NO: 1935 - DNA, 48 bp, Artificial Sequence
  synthetic
gcgagaggccctacttcggtgactacggactactacggtatggacgtc

SEQ ID NO: 1936 - protein, 16 aa, Artificial Sequence
  synthetic
ARGPTSVTTDYYGMDV

SEQ ID NO: 1937 - DNA, 327 bp, Artificial Sequence
  synthetic
gacatcgtgatgacccagtctccaggcaccctgtctttgtctccaggggaaagagccaccctctcctgcagggccagtcagagtgttagtagcagctacttagcctggtaccagcagaaacctggccaggctcccaggctcctcatctatgatgcgtccagcagggccactggcatcccagacaggttcagtggcagtgggtctgggacagacttcactctcaccatcaacagactggagcctgaagattttgcagtatattactgtcagcagtttggtccctcaccgttcacttttggccaggggaccaaggtggagatcaaacga

SEQ ID NO: 1938 - protein, 109 aa, Artificial Sequence
  synthetic
DIVMTQSPGTLSLSPGERATLSCRASQSVSSSYLAWYQQKPGQAPRLLIYDASSRATGIPDRFSGSGSGTDFTLTINRLEPEDFAVYYCQQFGPSPFTFGQGTKVEIKR

SEQ ID NO: 1939 - DNA, 21 bp, Artificial Sequence
  synthetic
cagagtgttagtagcagctac

SEQ ID NO: 1940 - protein, 7 aa, Artificial Sequence
  synthetic
QSVSSSY

SEQ ID NO: 1941 - DNA, 9 bp, Artificial Sequence
  synthetic
gatgcgtcc

SEQ ID NO: 1942 - protein, 3 aa, Artificial Sequence
  synthetic
DAS

SEQ ID NO: 1943 - DNA, 27 bp, Artificial Sequence
  synthetic
cagcagtttggtccctcaccgttcact

SEQ ID NO: 1944 - protein, 9 aa, Artificial Sequence
  synthetic
QQFGPSPFT

SEQ ID NO: 1945 - DNA, 363 bp, Artificial Sequence
  synthetic
gaggtgcagctggtggagtctgggggaggcttggtcaagcctggagggtccctgagactctcctgtgcagcctctggattcaccttcagtgactactacatgagctggatccgccagtctccagggaaggggctggagtgggtttcacacattagtggtagtggtaaaatcatatatcacgcagactatgtgaagggccgattcaccatctccagggacaacgccaagaagtcattgtatctgctaatgaacagcctgagagccgaagacacggccgtgtattactgtgcgagagaggaggtttactatgggtcggggagttttgagtactggggccagggaaccatggtcaccgtctcctca

SEQ ID NO: 1946 - protein, 121 aa, Artificial Sequence
  synthetic
EVQLVESGGGLVKPGGSLRLSCAASGFTFSDYYMSWIRQSPGKGLEWVSHISGSGKIIYHADYVKGRFTISRDNAKKSLYLLMNSLRAEDTAVYYCAREEVYYGSGSFEYWGQGTMVTVSS

SEQ ID NO: 1947 - DNA, 24 bp, Artificial Sequence
  synthetic
ggattcaccttcagtgactactac

SEQ ID NO: 1948 - protein, 8 aa, Artificial Sequence
  synthetic
GFTFSDYY

SEQ ID NO: 1949 - DNA, 24 bp, Artificial Sequence
  synthetic
attagtggtagtggtaaaatcata

SEQ ID NO: 1950 - protein, 8 aa, Artificial Sequence
  synthetic
ISGSGKII

SEQ ID NO: 1951 - DNA, 42 bp, Artificial Sequence
  synthetic
gcgagagaggaggtttactatgggtcggggagttttgagtac

SEQ ID NO: 1952 - protein, 14 aa, Artificial Sequence
  synthetic
AREEVYYGSGSFEY

SEQ ID NO: 1953 - DNA, 324 bp, Artificial Sequence
  synthetic
gacatcgtgatgacccagtctccagactttcagtctgtgactccaaaggagagagtcaccatcacctgccgggccagtcagaccattggtagcagcttacactggtaccagcagaaaccagatcagtctccaaagctcctcatcaagtatgcttcccagtccttctcaggggtcccctcgaggttcagtggcagtggatctgggacagatttcaccctcaccatcaatggcctggaagctgaagatgctgcaacgtattactgtcatcagagtagtagtttaccgtggacgttcggccaagggaccaaggtggaaatcaaacga

SEQ ID NO: 1954 - protein, 108 aa, Artificial Sequence
  synthetic
DIVMTQSPDFQSVTPKERVTITCRASQTIGSSLHWYQQKPDQSPKLLIKYASQSFSGVPSRFSGSGSGTDFTLTINGLEAEDAATYYCHQSSSLPWTFGQGTKVEIKR

SEQ ID NO: 1955 - DNA, 18 bp, Artificial Sequence
  synthetic
cagaccattggtagcagc

SEQ ID NO: 1956 - protein, 6 aa, Artificial Sequence
  synthetic
QTIGSS

SEQ ID NO: 1957 - DNA, 9 bp, Artificial Sequence
  synthetic
tatgcttcc

SEQ ID NO: 1958 - protein, 3 aa, Artificial Sequence
  synthetic
YAS

SEQ ID NO: 1959 - DNA, 27 bp, Artificial Sequence
  synthetic
catcagagtagtagtttaccgtggacg

SEQ ID NO: 1960 - protein, 9 aa, Artificial Sequence
  synthetic
HQSSSLPWT

SEQ ID NO: 1961 - DNA, 348 bp, Artificial Sequence
  synthetic
gaggtgcagctggtggagtctgggggaggcttggtacagcctggagggtccctgagactctcctgtgcagcctctggattcaccttcagtagttatgaaatgaactgggtccgccaggctccagggaaggggctggagtggatttcatacattagtactagtggtagtaccatatactacgctgactctgtgaagggccgattcaccatctccagagacgacgccaagaactcactgtatctgcaaatgaacagcctgagagccgaggacacggctgtttattactgtgcggtgggatatgggtggctacgattgtggggccagggaaccctggtcaccgtctcctca

SEQ ID NO: 1962 - protein, 116 aa, Artificial Sequence
  synthetic
EVQLVESGGGLVQPGGSLRLSCAASGFTFSSYEMNWVRQAPGKGLEWISYISTSGSTIYYADSVKGRFTISRDDAKNSLYLQMNSLRAEDTAVYYCAVGYGWLRLWGQGTLVTVSS

SEQ ID NO: 1963 - DNA, 24 bp, Artificial Sequence
  synthetic
ggattcaccttcagtagttatgaa

SEQ ID NO: 1964 - protein, 8 aa, Artificial Sequence
  synthetic
GFTFSSYE

SEQ ID NO: 1965 - DNA, 24 bp, Artificial Sequence
  synthetic
attagtactagtggtagtaccata

SEQ ID NO: 1966 - protein, 8 aa, Artificial Sequence
  synthetic
ISTSGSTI

SEQ ID NO: 1967 - DNA, 27 bp, Artificial Sequence
  synthetic
gcggtgggatatgggtggctacgattg

SEQ ID NO: 1968 - protein, 9 aa, Artificial Sequence
  synthetic
AVGYGWLRL

SEQ ID NO: 1969 - DNA, 324 bp, Artificial Sequence
  synthetic
gacatcctgatgacccagtctccatcctccctgtctgcatctgttggagacagagtcaccatcacttgccgggcgagtcagggcattagcatttatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtatagcagtgccccattcactttcggccctgggaccaaggtggagatcaaacga

SEQ ID NO: 1970 - protein, 108 aa, Artificial Sequence
  synthetic
DILMTQSPSSLSASVGDRVTITCRASQGISIYLAWYQQKPGKVPKLLIYAASTLQSGVPSRFSGSGSGTDFTLTISSLQPEDVATYYCQKYSSAPFTFGPGTKVEIKR

SEQ ID NO: 1971 - DNA, 18 bp, Artificial Sequence
  synthetic
cagggcattagcatttat

SEQ ID NO: 1972 - protein, 6 aa, Artificial Sequence
  synthetic
QGISIY

SEQ ID NO: 1973 - DNA, 9 bp, Artificial Sequence
  synthetic
gctgcatcc

SEQ ID NO: 1974 - protein, 3 aa, Artificial Sequence
  synthetic
AAS

SEQ ID NO: 1975 - DNA, 27 bp, Artificial Sequence
  synthetic
caaaagtatagcagtgccccattcact

SEQ ID NO: 1976 - protein, 9 aa, Artificial Sequence
  synthetic
QKYSSAPFT

SEQ ID NO: 1977 - DNA, 369 bp, Artificial Sequence
  synthetic
caggtgcagctggtggagtcgggcccaggactggtgaagccttcggacaccctgtccctcacctgcgctgtctctggttactccataaacagtaataactggtggggttggatccggcagcccccagggaagggactggagtggattgggtacatctattataatgggaacatctactacaacccgtccctcaagagtcgagtcaccatgtcagtagacacgtccgagaaccagttctccctgaagctgagctctgtgaccgccgtggacacggccgtgtattactgtgcgaggtgtattacgatttttggagtggttatctccgcttttgatgtctggggccaagggacaatggtcaccgtctcttca

SEQ ID NO: 1978 - protein, 123 aa, Artificial Sequence
  synthetic
QVQLVESGPGLVKPSDTLSLTCAVSGYSINSNNWWGWIRQPPGKGLEWIGYIYYNGNIYYNPSLKSRVTMSVDTSENQFSLKLSSVTAVDTAVYYCARCITIFGVVISAFDVWGQGTMVTVSS

SEQ ID NO: 1979 - DNA, 27 bp, Artificial Sequence
  synthetic
ggttactccataaacagtaataactgg

SEQ ID NO: 1980 - protein, 9 aa, Artificial Sequence
  synthetic
GYSINSNNW

SEQ ID NO: 1981 - DNA, 21 bp, Artificial Sequence
  synthetic
atctattataatgggaacatc

SEQ ID NO: 1982 - protein, 7 aa, Artificial Sequence
  synthetic
IYYNGNI

SEQ ID NO: 1983 - DNA, 48 bp, Artificial Sequence
  synthetic
gcgaggtgtattacgatttttggagtggttatctccgcttttgatgtc

SEQ ID NO: 1984 - protein, 16 aa, Artificial Sequence
  synthetic
ARCITIFGVVISAFDV

SEQ ID NO: 1985 - DNA, 324 bp, Artificial Sequence; identical to SEQ ID NO: 497
  synthetic

SEQ ID NO: 1986 - protein, 108 aa, Artificial Sequence; identical to SEQ ID NO: 498
  synthetic

SEQ ID NO: 1987 - DNA, 18 bp, Artificial Sequence
  synthetic
cagagcattagcagctat

SEQ ID NO: 1988 - protein, 6 aa, Artificial Sequence
  synthetic
QSISSY

SEQ ID NO: 1989 - DNA, 9 bp, Artificial Sequence
  synthetic
gctgcatcc

SEQ ID NO: 1990 - protein, 3 aa, Artificial Sequence
  synthetic
AAS

SEQ ID NO: 1991 - DNA, 27 bp, Artificial Sequence
  synthetic
caacagagttacagtaccccgtacact

SEQ ID NO: 1992 - protein, 9 aa, Artificial Sequence
  synthetic
QQSYSTPYT

SEQ ID NO: 1993 - DNA, 348 bp, Artificial Sequence
  synthetic
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaacatatactacgcagactctgtgaagggccgattcaccatctccagagacaacgccaagaactcattgtatctgcaaatgaacagcctgacagccgaggacacggctgtttattactgtgcggtgggatatgggtggctacgattgtggggccagggaaccctggtcaccgtctcctca

SEQ ID NO: 1994 - protein, 116 aa, Artificial Sequence
  synthetic
EVQLVESGGGLVQPGGSLRLSCAASGFTFSSYEMNWVRQAPGKGLEWVSYISSSGSNIYYADSVKGRFTISRDNAKNSLYLQMNSLTAEDTAVYYCAVGYGWLRLWGQGTLVTVSS

SEQ ID NO: 1995 - DNA, 24 bp, Artificial Sequence
  synthetic
ggattcaccttcagtagttatgaa

SEQ ID NO: 1996 - protein, 8 aa, Artificial Sequence
  synthetic
GFTFSSYE

SEQ ID NO: 1997 - DNA, 24 bp, Artificial Sequence
  synthetic
attagtagtagtggtagtaacata

SEQ ID NO: 1998 - protein, 8 aa, Artificial Sequence
  synthetic
ISSSGSNI

SEQ ID NO: 1999 - DNA, 27 bp, Artificial Sequence
  synthetic
gcggtgggatatgggtggctacgattg

SEQ ID NO: 2000 - protein, 9 aa, Artificial Sequence
  synthetic
AVGYGWLRL

SEQ ID NO: 2001 - DNA, 324 bp, Artificial Sequence
  synthetic
gacatccagatgacccagtctccatcctccctgtctgcatctgtaggagacagagtcaccctcacttgccgggcgagtcagggcattagcttttatttagcctggtatcagcagaaaccagggaaagttcctaacctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccattcactttcggccctgggaccaaggtggagatcaaacga

SEQ ID NO: 2002 - protein, 108 aa, Artificial Sequence
  synthetic
DIQMTQSPSSLSASVGDRVTLTCRASQGISFYLAWYQQKPGKVPNLLIYAASTLQSGVPSRFSGSGSGTDFTLTISSLQPEDVATYYCQKYNSAPFTFGPGTKVEIKR

SEQ ID NO: 2003 - DNA, 18 bp, Artificial Sequence
  synthetic
cagggcattagcttttat

SEQ ID NO: 2004 - protein, 6 aa, Artificial Sequence
  synthetic
QGISFY

SEQ ID NO: 2005 - DNA, 9 bp, Artificial Sequence
  synthetic
gctgcatcc

SEQ ID NO: 2006 - protein, 3 aa, Artificial Sequence
  synthetic
AAS

SEQ ID NO: 2007 - DNA, 27 bp, Artificial Sequence
  synthetic
caaaagtataacagtgccccattcact

SEQ ID NO: 2008 - protein, 9 aa, Artificial Sequence
  synthetic
QKYNSAPFT

SEQ ID NO: 2009 - DNA, 372 bp, Artificial Sequence
  synthetic
gaggtgcagctggtggagtctgggggaggcgtggtccagcctgggaggtccctgagactctcctgtgcagcgtctggattcaccttcagtagctgtgccatgcactgggtccgccaggctccaggcaaggggctggagtgggtggcagttatatggtatgatggaggtaataaatactatgcagactccgtgaagggccgattcaccatctccagagacaattccaagaacacgctgtatctgcaaatgaatagcctgagagccgaggacacggctgtctattactgtgcgagagatttatttttggagcccccctacaactactacggtatggacgtctggggccaagggaccacggtcaccgtctcctca

SEQ ID NO: 2010 - protein, 124 aa, Artificial Sequence
  synthetic
EVQLVESGGGVVQPGRSLRLSCAASGFTFSSCAMHWVRQAPGKGLEWVAVIWYDGGNKYYADSVKGRFTISRDNSKNTLYLQMNSLRAEDTAVYYCARDLFLEPPYNYYGMDVWGQGTTVTVSS

SEQ ID NO: 2011 - DNA, 24 bp, Artificial Sequence
  synthetic
ggattcaccttcagtagctgtgcc

SEQ ID NO: 2012 - protein, 8 aa, Artificial Sequence
  synthetic
GFTFSSCA

SEQ ID NO: 2013 - DNA, 24 bp, Artificial Sequence
  synthetic
atatggtatgatggaggtaataaa

SEQ ID NO: 2014 - protein, 8 aa, Artificial Sequence
  synthetic
IWYDGGNK

SEQ ID NO: 2015 - DNA, 51 bp, Artificial Sequence
  synthetic
gcgagagatttatttttggagcccccctacaactactacggtatggacgtc

SEQ ID NO: 2016 - protein, 17 aa, Artificial Sequence
  synthetic
ARDLFLEPPYNYYGMDV

SEQ ID NO: 2017 - DNA, 324 bp, Artificial Sequence
  synthetic
gacatcctgatgacccagtctccatcctccctgtctgcatctgtaggagacagagtcaccatcacttgccaggcgagtcaggacattaccaactatttaaattggtatcagcagaaaccagggaaagcccctaaactcctgatctacgctgcatccaatttggaaacaggggtcccatcaaggttcagtggaagtggatctgggacagattttactttcaccatcagcagcctgcagcctgaagattttgcaacatattattgtcaacactatgataattttccgctcactttcggcggagggaccaaggtggagatcaaacga

SEQ ID NO: 2018 - protein, 108 aa, Artificial Sequence
  synthetic
DILMTQSPSSLSASVGDRVTITCQASQDITNYLNWYQQKPGKAPKLLIYAASNLETGVPSRFSGSGSGTDFTFTISSLQPEDFATYYCQHYDNFPLTFGGGTKVEIKR

SEQ ID NO: 2019 - DNA, 18 bp, Artificial Sequence
  synthetic
caggacattaccaactat

SEQ ID NO: 2020 - protein, 6 aa, Artificial Sequence
  synthetic
QDITNY

SEQ ID NO: 2021 - DNA, 9 bp, Artificial Sequence
  synthetic
gctgcatcc

SEQ ID NO: 2022 - protein, 3 aa, Artificial Sequence
  synthetic
AAS

SEQ ID NO: 2023 - DNA, 27 bp, Artificial Sequence
  synthetic
caacactatgataattttccgctcact

SEQ ID NO: 2024 - protein, 9 aa, Artificial Sequence
  synthetic
QHYDNFPLT

SEQ ID NO: 2025 - DNA, 348 bp, Artificial Sequence
  synthetic
gaggtgcagctggtggagtctgggggaggcttggtacagcctggagggtccctgagactctcctgtgcagcctctggattcaccttcagtagttatgaaatgaactgggtccgccaggctccagggaagggactggagtgggtttcatacataagtagtagtggtagtaatatatactatgcagactctgtgaagggccgattcaccatctccagagacaacgtcaagaattcattgtatctgcaaataaacagcctgacagccgaggacacggctgtttattactgtgcggtgggatatgggtggctacgattgtggggccagggaaccctggtcaccgtctcctca

SEQ ID NO: 2026 - protein, 116 aa, Artificial Sequence
  synthetic
EVQLVESGGGLVQPGGSLRLSCAASGFTFSSYEMNWVRQAPGKGLEWVSYISSSGSNIYYADSVKGRFTISRDNVKNSLYLQINSLTAEDTAVYYCAVGYGWLRLWGQGTLVTVSS

SEQ ID NO: 2027 - DNA, 24 bp, Artificial Sequence
  synthetic
ggattcaccttcagtagttatgaa

SEQ ID NO: 2028 - protein, 8 aa, Artificial Sequence
  synthetic
GFTFSSYE

SEQ ID NO: 2029 - DNA, 24 bp, Artificial Sequence
  synthetic
ataagtagtagtggtagtaatata

SEQ ID NO: 2030 - protein, 8 aa, Artificial Sequence
  synthetic
ISSSGSNI

SEQ ID NO: 2031 - DNA, 27 bp, Artificial Sequence
  synthetic
gcggtgggatatgggtggctacgattg

SEQ ID NO: 2032 - protein, 9 aa, Artificial Sequence
  synthetic
AVGYGWLRL

SEQ ID NO: 2033 - DNA, 324 bp, Artificial Sequence
  synthetic
gacatccagatgacccagtctccatcctccctgtctgcatctgtaggagacagagtcaccatcacttgccgggcgagtcagggcattagcttttatttagcctggtatcagcagaaaccagggaaacttcctaacctcctgatctatgctgcatccactttgcaatcaggggtcccatcccggttcagtggcagtggatctgggacagatttcactctcacgatcagcagcctgcagcctgaagatgttgcaacttattactgtcaaaagtataacagtgccccattcactttcggccctgggaccaaggtggagatcaaacga

SEQ ID NO: 2034 - protein, 108 aa, Artificial Sequence
  synthetic
DIQMTQSPSSLSASVGDRVTITCRASQGISFYLAWYQQKPGKLPNLLIYAASTLQSGVPSRFSGSGSGTDFTLTISSLQPEDVATYYCQKYNSAPFTFGPGTKVEIKR

SEQ ID NO: 2035 - DNA, 18 bp, Artificial Sequence
  synthetic
cagggcattagcttttat

SEQ ID NO: 2036 - protein, 6 aa, Artificial Sequence
  synthetic
QGISFY

SEQ ID NO: 2037 - DNA, 9 bp, Artificial Sequence
  synthetic
gctgcatcc

SEQ ID NO: 2038 - protein, 3 aa, Artificial Sequence
  synthetic
AAS

SEQ ID NO: 2039 - DNA, 27 bp, Artificial Sequence
  synthetic
caaaagtataacagtgccccattcact

SEQ ID NO: 2040 - protein, 9 aa, Artificial Sequence
  synthetic
QKYNSAPFT

SEQ ID NO: 2041 - DNA, 357 bp, Artificial Sequence
  synthetic
caggtgcagctggtgcagtggggcgcaggactgttgaagccttcggagaccctgtccctcacctgcgctgtctatgctgggcccttcagtggttacttttggagctggatccgccagcccccagggaaggggctggagtggattggggaaatcaatcatagtggaagcacaaactacaacccgtccctcaggagtcgagtcaccatatcagtagatacgtccaataaccagttctccctgaaactgagctctgtgaccgccgcggacacggctaattattactgtgcgagaggccgagagatactcgtttactactttgactactggggccagggaaccctggtcaccgtctcctca

SEQ ID NO: 2042 - protein, 119 aa, Artificial Sequence
  synthetic
QVQLVQWGAGLLKPSETLSLTCAVYAGPFSGYFWSWIRQPPGKGLEWIGEINHSGSTNYNPSLRSRVTISVDTSNNQFSLKLSSVTAADTANYYCARGREILVYYFDYWGQGTLVTVSS

SEQ ID NO: 2043 - DNA, 24 bp, Artificial Sequence
  synthetic
gctgggcccttcagtggttacttt

SEQ ID NO: 2044 - protein, 8 aa, Artificial Sequence
  synthetic
AGPFSGYF

SEQ ID NO: 2045 - DNA, 21 bp, Artificial Sequence
  synthetic
atcaatcatagtggaagcaca

SEQ ID NO: 2046 - protein, 7 aa, Artificial Sequence
  synthetic
INHSGST

SEQ ID NO: 2047 - DNA, 39 bp, Artificial Sequence
  synthetic
gcgagaggccgagagatactcgtttactactttgactac

SEQ ID NO: 2048 - protein, 13 aa, Artificial Sequence
  synthetic
ARGREILVYYFDY

SEQ ID NO: 2049 - DNA, 324 bp, Artificial Sequence
  synthetic
gacatccagatgacccagtctccttccaccctgtctgcatctgtaggagacagagtcaccatcacttgccgggccagtcagagtattgattactggttggcctggtatcagcagagaccagggaaagcccctaaactcctgatctataaggcgtctactttagaaagtggggtcccatcaaggttcagcggcagtggatctgggacagaattcactctcaccgtcagcagcctgcagcctgatgattttgcaacttattactgccaacagtatcatagttattcgtacacttttggccaggggaccaaggtggagatcaaacga

SEQ ID NO: 2050 - protein, 108 aa, Artificial Sequence
  synthetic
DIQMTQSPSTLSASVGDRVTITCRASQSIDYWLAWYQQRPGKAPKLLIYKASTLESGVPSRFSGSGSGTEFTLTVSSLQPDDFATYYCQQYHSYSYTFGQGTKVEIKR

SEQ ID NO: 2051 - DNA, 18 bp, Artificial Sequence
  synthetic
cagagtattgattactgg

SEQ ID NO: 2052 - protein, 6 aa, Artificial Sequence
  synthetic
QSIDYW

SEQ ID NO: 2053 - DNA, 9 bp, Artificial Sequence
  synthetic
aaggcgtct

SEQ ID NO: 2054 - protein, 3 aa, Artificial Sequence
  synthetic
KAS

SEQ ID NO: 2055 - DNA, 27 bp, Artificial Sequence
  synthetic
caacagtatcatagttattcgtacact

SEQ ID NO: 2056 - protein, 9 aa, Artificial Sequence
  synthetic
QQYHSYSYT

SEQ ID NO: 2057 - DNA, 366 bp, Artificial Sequence
  synthetic
caggtgcagctggtgcagtggggcgcaggactgttgaagccttcggagaccctgtccctcacctgcgctgtctatggtgggaccttcaatttttaccagtggagttggatccgccagcccccagggaagggtctggagtggattggggaaatcaatcatactggaagcaccaactacaacccgtccctcaagagtcgagtcaccatttcagtagacacgtccaagacccagttctccctgaaggtgagctctgtgaccgccgcggacacggctgtttattactgtgcgagaggcccctcttcaataactacggactactacggtatggacgtctggggccaagggaccacggtcaccgtctcctca

SEQ ID NO: 2058 - protein, 122 aa, Artificial Sequence
  synthetic
QVQLVQWGAGLLKPSETLSLTCAVYGGTFNFYQWSWIRQPPGKGLEWIGEINHTGSTNYNPSLKSRVTISVDTSKTQFSLKVSSVTAADTAVYYCARGPSSITTDYYGMDVWGQGTTVTVSS

SEQ ID NO: 2059 - DNA, 24 bp, Artificial Sequence
  synthetic
ggtgggaccttcaatttttaccag

SEQ ID NO: 2060 - protein, 8 aa, Artificial Sequence
  synthetic
GGTFNFYQ

SEQ ID NO: 2061 - DNA, 21 bp, Artificial Sequence
  synthetic
atcaatcatactggaagcacc

SEQ ID NO: 2062 - protein, 7 aa, Artificial Sequence
  synthetic
INHTGST

SEQ ID NO: 2063 - DNA, 48 bp, Artificial Sequence
  synthetic
gcgagaggcccctcttcaataactacggactactacggtatggacgtc

SEQ ID NO: 2064 - protein, 16 aa, Artificial Sequence
  synthetic
ARGPSSITTDYYGMDV

SEQ ID NO: 2065 - DNA, 327 bp, Artificial Sequence
  synthetic
gacatcgtgatgacccagtctccaggcaccctgtctttgtctccaggggaaagagccaccctctcctgcagggccagccagagtgttagtatcaactacttagcctggtaccagcagaaacctggccaggctcccaggcgcctcatctatgaaacatttagcagggccactggcatcccagacaggttcagtggcagtgggtctgggacagacttcactctcaccatcagcagactggagcctgaagattttgcagtgtattactgtcagcagtatggtgactcaccgtacacttttggccaggggaccaaggtggagatcaaacga

SEQ ID NO: 2066 - protein, 109 aa, Artificial Sequence
  synthetic
DIVMTQSPGTLSLSPGERATLSCRASQSVSINYLAWYQQKPGQAPRRLIYETFSRATGIPDRFSGSGSGTDFTLTISRLEPEDFAVYYCQQYGDSPYTFGQGTKVEIKR

SEQ ID NO: 2067 - DNA, 21 bp, Artificial Sequence
  synthetic
cagagtgttagtatcaactac

SEQ ID NO: 2068 - protein, 7 aa, Artificial Sequence
  synthetic
QSVSINY

SEQ ID NO: 2069 - DNA, 9 bp, Artificial Sequence
  synthetic
gaaacattt

SEQ ID NO: 2070 - protein, 3 aa, Artificial Sequence
  synthetic
ETF

SEQ ID NO: 2071 - DNA, 27 bp, Artificial Sequence
  synthetic
cagcagtatggtgactcaccgtacact

SEQ ID NO: 2072 - protein, 9 aa, Artificial Sequence
  synthetic
QQYGDSPYT

SEQ ID NO: 2073 - DNA, 363 bp, Artificial Sequence
  synthetic
gaggtgcagctggtggagtctgggggaggcttggtacagcctggagggtccctaagactctcctgtgtaatctctggattcatctttaggagttatgccatgacctgggtccgccaggctccagggaaggggctggagtgggtctcaggtgtaagtggtagtggtgataccacaaactacgcagactccgtgaagggccggttcaccatctccagagacaattccaagaacacggtgtttctgcaaatgaacagcctgagagccgaggacacggccgtatattactgtgcgaaagattttctgggaactaccttctacggtatggacgtctggggccatgggaccacggtcaccgtctcctca

SEQ ID NO: 2074 - protein, 121 aa, Artificial Sequence
  synthetic
EVQLVESGGGLVQPGGSLRLSCVISGFIFRSYAMTWVRQAPGKGLEWVSGVSGSGDTTNYADSVKGRFTISRDNSKNTVFLQMNSLRAEDTAVYYCAKDFLGTTFYGMDVWGHGTTVTVSS

SEQ ID NO: 2075 - DNA, 24 bp, Artificial Sequence
  synthetic
ggattcatctttaggagttatgcc

SEQ ID NO: 2076 - protein, 8 aa, Artificial Sequence
  synthetic
GFIFRSYA

SEQ ID NO: 2077 - DNA, 24 bp, Artificial Sequence
  synthetic
gtaagtggtagtggtgataccaca

SEQ ID NO: 2078 - protein, 8 aa, Artificial Sequence
  synthetic
VSGSGDTT

SEQ ID NO: 2079 - DNA, 42 bp, Artificial Sequence
  synthetic
gcgaaagattttctgggaactaccttctacggtatggacgtc

SEQ ID NO: 2080 - protein, 14 aa, Artificial Sequence
  synthetic
AKDFLGTTFYGMDV

SEQ ID NO: 2081 - DNA, 324 bp, Artificial Sequence
  synthetic
gacatcgtgatgacccagtctccagccaccctgtctttgtctccaggggaaagagccaccctctcctgcagggccagtcagagtgttagcaggttcttagcctggtaccaacagaaacctggccaggctcccaggctcctcatctatgaaacatccaacagggccactggcatcccagccaggttcagtggcagtgggtctgggacagacttcactctcaccatcagcagcctagagcctgaagattgtgcagtttattactgtcagcagcggaacaactggcctcctattttcggcggagggaccaaggtggagatcaaacga

SEQ ID NO: 2082 - protein, 108 aa, Artificial Sequence
  synthetic
DIVMTQSPATLSLSPGERATLSCRASQSVSRFLAWYQQKPGQAPRLLIYETSNRATGIPARFSGSGSGTDFTLTISSLEPEDCAVYYCQQRNNWPPIFGGGTKVEIKR

SEQ ID NO: 2083 - DNA, 18 bp, Artificial Sequence
  synthetic
cagagtgttagcaggttc

SEQ ID NO: 2084 - protein, 6 aa, Artificial Sequence
  synthetic
QSVSRF

SEQ ID NO: 2085 - DNA, 9 bp, Artificial Sequence
  synthetic
gaaacatcc

SEQ ID NO: 2086 - protein, 3 aa, Artificial Sequence
  synthetic
ETS

SEQ ID NO: 2087 - DNA, 27 bp, Artificial Sequence
  synthetic
cagcagcggaacaactggcctcctatt

SEQ ID NO: 2088 - protein, 9 aa, Artificial Sequence
  synthetic
QQRNNWPPI

SEQ ID NO: 2089 - DNA, 360 bp, Artificial Sequence
  synthetic
caggtgcagctggtggagtctgggggaggcttggtcaagcctggagggtccctgagactctcctgtgcagcctctggattcaccttcagcaactactatatgagctggatccgccagtctccagggaagggactggaatgggtctcatatattagtaatagtggtagtaccatatcttatgcagactctgtgcagggccgattcaccatctccagggacaacgccaagaactcactgtttctacaaatgaacagcctgagggccgaggacacggccgcatattactgtgcgagagagggtatcgcacctgctggcctctttgactactggggccagggaaccctggtcaccgtctcctca

SEQ ID NO: 2090 - protein, 120 aa, Artificial Sequence
  synthetic
QVQLVESGGGLVKPGGSLRLSCAASGFTFSNYYMSWIRQSPGKGLEWVSYISNSGSTISYADSVQGRFTISRDNAKNSLFLQMNSLRAEDTAAYYCAREGIAPAGLFDYWGQGTLVTVSS

SEQ ID NO: 2091 - DNA, 24 bp, Artificial Sequence
  synthetic
ggattcaccttcagcaactactat

SEQ ID NO: 2092 - protein, 8 aa, Artificial Sequence
  synthetic
GFTFSNYY

SEQ ID NO: 2093 - DNA, 24 bp, Artificial Sequence
  synthetic
attagtaatagtggtagtaccata

SEQ ID NO: 2094 - protein, 8 aa, Artificial Sequence
  synthetic
ISNSGSTI

SEQ ID NO: 2095 - DNA, 39 bp, Artificial Sequence
  synthetic
gcgagagagggtatcgcacctgctggcctctttgactac

SEQ ID NO: 2096 - protein, 13 aa, Artificial Sequence
  synthetic
AREGIAPAGLFDY

SEQ ID NO: 2097 - DNA, 324 bp, Artificial Sequence
  synthetic
gacatccagatgacccagtctccatcctccctgtctgcatctgtgggagacagagtcaccatcacttgccgggcgagtcaggccattagaagttatttagcctggtatcagaagagaccagggaaagttcctaaactcctgatctatgctgcatccactttacattcaggggtcccatctcgtttcagtggcagtggatctgggacagatttcactctcaccatcagcagcctgcagcctgaagatgttacaacttattactgtcaaaactataacagtcccccgtggacattcggccaagggaccaaggtggagatcaaacga

SEQ ID NO: 2098 - protein, 108 aa, Artificial Sequence
  synthetic
DIQMTQSPSSLSASVGDRVTITCRASQAIRSYLAWYQKRPGKVPKLLIYAASTLHSGVPSRFSGSGSGTDFTLTISSLQPEDVTTYYCQNYNSPPWTFGQGTKVEIKR

SEQ ID NO: 2099 - DNA, 18 bp, Artificial Sequence
  synthetic
caggccattagaagttat

SEQ ID NO: 2100 - protein, 6 aa, Artificial Sequence
  synthetic
QAIRSY

SEQ ID NO: 2101 - DNA, 9 bp, Artificial Sequence
  synthetic
gctgcatcc

SEQ ID NO: 2102 - protein, 3 aa, Artificial Sequence
  synthetic
AAS

SEQ ID NO: 2103 - DNA, 27 bp, Artificial Sequence
  synthetic
caaaactataacagtcccccgtggaca

SEQ ID NO: 2104 - protein, 9 aa, Artificial Sequence
  synthetic
QNYNSPPWT

SEQ ID NO: 2105 - DNA, 372 bp, Artificial Sequence
  synthetic
caggtgcagctggtggagtctgggggaggcgtggtccagcctgggaggtccctgagactctcctgtgcagcgtctggattcaccttcaatagctttgcattccactgggtccgccaggctccaggcaaggggctggagtgggtggcagttatatggtatgatggaagtaataaatattatggagactccgtgaagggccgattcaccatctccagagacaattccaagaacacgctgtatctgcaaatgaacagcctgagagtcgaggacacggctatatattattgtgcgagggatttctttttggagcccccctatcattactacggaatggacgtctggggccaagggaccacggtcaccgtctcctca

SEQ ID NO: 2106 - protein, 124 aa, Artificial Sequence
  synthetic
QVQLVESGGGVVQPGRSLRLSCAASGFTFNSFAFHWVRQAPGKGLEWVAVIWYDGSNKYYGDSVKGRFTISRDNSKNTLYLQMNSLRVEDTAIYYCARDFFLEPPYHYYGMDVWGQGTTVTVSS

SEQ ID NO: 2107 - DNA, 24 bp, Artificial Sequence
  synthetic
ggattcaccttcaatagctttgca

SEQ ID NO: 2108 - protein, 8 aa, Artificial Sequence
  synthetic
GFTFNSFA

SEQ ID NO: 2109 - DNA, 24 bp, Artificial Sequence
  synthetic
atatggtatgatggaagtaataaa

SEQ ID NO: 2110 - protein, 8 aa, Artificial Sequence
  synthetic
IWYDGSNK

SEQ ID NO: 2111 - DNA, 51 bp, Artificial Sequence
  synthetic
gcgagggatttctttttggagcccccctatcattactacggaatggacgtc

SEQ ID NO: 2112 - protein, 17 aa, Artificial Sequence
  synthetic
ARDFFLEPPYHYYGMDV

SEQ ID NO: 2113 - DNA, 324 bp, Artificial Sequence
  synthetic
gacatcctgatgacccagtctccatcctccctgtctgcatctgtaggagacagagtcaccatcacctgccaggcgagtcaggacattatcaactatttaaattggtatcaacagaaaccagggaaagcccctaagctccttatttacgctgcatccactttggaaacaggggtcccatcaaggttcagtggaagtggatctgggacagattttactttcaccatcagaaccctgcagcctgaagatcttgcaacatattactgtcaacaatatgataatctccccctcactttcggcggagggaccaaggtggagatcaaacga

SEQ ID NO: 2114 - protein, 108 aa, Artificial Sequence
  synthetic
DILMTQSPSSLSASVGDRVTITCQASQDIINYLNWYQQKPGKAPKLLIYAASTLETGVPSRFSGSGSGTDFTFTIRTLQPEDLATYYCQQYDNLPLTFGGGTKVEIKR

SEQ ID NO: 2115 - DNA, 18 bp, Artificial Sequence
  synthetic
caggacattatcaactat

SEQ ID NO: 2116 - protein, 6 aa, Artificial Sequence
  synthetic
QDIINY

SEQ ID NO: 2117 - DNA, 9 bp, Artificial Sequence
  synthetic
gctgcatcc

SEQ ID NO: 2118 - protein, 3 aa, Artificial Sequence
  synthetic
AAS

SEQ ID NO: 2119 - DNA, 27 bp, Artificial Sequence
  synthetic
caacaatatgataatctccccctcact

SEQ ID NO: 2120 - protein, 9 aa, Artificial Sequence
  synthetic
QQYDNLPLT

SEQ ID NO: 2121 - DNA, 363 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagttccagggaagggcctggagtgggtctcaggcattagttggaatagtgataatgtcgactatgcggactctgtgaagggccgattcaccatctccagagacaacgccaagaactccctgtatctgcaaatgaacagtctgagacctgaagacacggccttgtattactgtgcaaaagatgtagatatactggccccctacggaatggacgtctggggccaagggacaatggtcaccgtctcctca

SEQ ID NO: 2122 - protein, 121 aa, Artificial Sequence
  synthetic
EVQLVESGGGLVQPGRSLRLSCAASGFTFDDYAMHWVRQVPGKGLEWVSGISWNSDNVDYADSVKGRFTISRDNAKNSLYLQMNSLRPEDTALYYCAKDVDILAPYGMDVWGQGTMVTVSS

SEQ ID NO: 2123 - DNA, 24 bp, Artificial Sequence
  synthetic
ggattcacctttgatgattatgcc

SEQ ID NO: 2124 - protein, 8 aa, Artificial Sequence
  synthetic
GFTFDDYA

SEQ ID NO: 2125 - DNA, 24 bp, Artificial Sequence
  synthetic
attagttggaatagtgataatgtc

SEQ ID NO: 2126 - protein, 8 aa, Artificial Sequence
  synthetic
ISWNSDNV

SEQ ID NO: 2127 - DNA, 42 bp, Artificial Sequence
  synthetic
gcaaaagatgtagatatactggccccctacggaatggacgtc

SEQ ID NO: 2128 - protein, 14 aa, Artificial Sequence
  synthetic
AKDVDILAPYGMDV

SEQ ID NO: 2129 - DNA, 330 bp, Artificial Sequence
  synthetic
gacatcgtgatgacccagtctccaggcaccctgtctttgtctccaggggaaagagcctccctctcctgcagggccagtcagattgttaacagcaactactttgcctggtaccaacagaaacctggccactctcccaggctcctcctctatggtccatccaggagggccactggtatcccagacacgttcagtggcagtgggtctgggacagacttcactctcaccatcagcagacttgagcctgaagattttgcattttattactgtcagcactatggtatctcatacatgtatgcgtttggccaggggaccaaggtggagatcaaacga

SEQ ID NO: 2130 - protein, 110 aa, Artificial Sequence
  synthetic
DIVMTQSPGTLSLSPGERASLSCRASQIVNSNYFAWYQQKPGHSPRLLLYGPSRRATGIPDTFSGSGSGTDFTLTISRLEPEDFAFYYCQHYGISYMYAFGQGTKVEIKR

SEQ ID NO: 2131 - DNA, 21 bp, Artificial Sequence
  synthetic
cagattgttaacagcaactac

SEQ ID NO: 2132 - protein, 7 aa, Artificial Sequence
  synthetic
QIVNSNY

SEQ ID NO: 2133 - DNA, 9 bp, Artificial Sequence
  synthetic
ggtccatcc

SEQ ID NO: 2134 - protein, 3 aa, Artificial Sequence
  synthetic
GPS

SEQ ID NO: 2135 - DNA, 30 bp, Artificial Sequence
  synthetic
cagcactatggtatctcatacatgtatgcg

SEQ ID NO: 2136 - protein, 10 aa, Artificial Sequence
  synthetic
QHYGISYMYA

SEQ ID NO: 2137 - DNA, 363 bp, Artificial Sequence
  synthetic
gaggtgcagctggtggagtctgggggaggcttggtacagcctggcaggtccctgaaactctcctgtgtagcctcaggattcacctttgatgattatgatatgtattgggtccggcaagttccagggaagggcctggagtgggtctcaactataagttggaatagtgaaaacatagactacgcggactctgtcaagggccgattcaccatctccagagacaacgccgagaactccctgtatttgcaaatgaacagtctgagagctgaggacacggccttgtattactgtacaaaaaatatagatatattggccccctatggaatggacgtctggggccaagggaccacggtcaccgtctcctca

SEQ ID NO: 2138 - protein, 121 aa, Artificial Sequence
  synthetic
EVQLVESGGGLVQPGRSLKLSCVASGFTFDDYDMYWVRQVPGKGLEWVSTISWNSENIDYADSVKGRFTISRDNAENSLYLQMNSLRAEDTALYYCTKNIDILAPYGMDVWGQGTTVTVSS

SEQ ID NO: 2139 - DNA, 24 bp, Artificial Sequence
  synthetic
ggattcacctttgatgattatgat

SEQ ID NO: 2140 - protein, 8 aa, Artificial Sequence
  synthetic
GFTFDDYD

SEQ ID NO: 2141 - DNA, 24 bp, Artificial Sequence
  synthetic
ataagttggaatagtgaaaacata

SEQ ID NO: 2142 - protein, 8 aa, Artificial Sequence
  synthetic
ISWNSENI

SEQ ID NO: 2143 - DNA, 42 bp, Artificial Sequence
  synthetic
acaaaaaatatagatatattggccccctatggaatggacgtc

SEQ ID NO: 2144 - protein, 14 aa, Artificial Sequence
  synthetic
TKNIDILAPYGMDV

SEQ ID NO: 2145 - DNA, 324 bp, Artificial Sequence
  synthetic
gacatcctgatgacccagtctccaggcaccctgtctttgtctccaggggaaagagccaccctatcctgcagggccagtcagattattaacagcaactatttggcctggtaccagcagaaacctggccaggctcccaggctcctcatctatggtgcatccagaagggccactggcatccccgataggttcagtcgcagtgggtctgggacagacttcactctcaccatcagcagactggagcctgaagattttgcagtctattactgtcagcactatggtagttcatacacttttggccaggggaccaaggtggagatcaaacga

SEQ ID NO: 2146 - protein, 108 aa, Artificial Sequence
  synthetic
DILMTQSPGTLSLSPGERATLSCRASQIINSNYLAWYQQKPGQAPRLLIYGASRRATGIPDRFSRSGSGTDFTLTISRLEPEDFAVYYCQHYGSSYTFGQGTKVEIKR

SEQ ID NO: 2147 - DNA, 21 bp, Artificial Sequence
  synthetic
cagattattaacagcaactat

SEQ ID NO: 2148 - protein, 7 aa, Artificial Sequence
  synthetic
QIINSNY

SEQ ID NO: 2149 - DNA, 9 bp, Artificial Sequence
  synthetic
ggtgcatcc

SEQ ID NO: 2150 - protein, 3 aa, Artificial Sequence
  synthetic
GAS

SEQ ID NO: 2151 - DNA, 24 bp, Artificial Sequence
  synthetic
cagcactatggtagttcatacact

SEQ ID NO: 2152 - protein, 8 aa, Artificial Sequence
  synthetic
QHYGSSYT

SEQ ID NO: 2153 - DNA, 378 bp, Artificial Sequence
  synthetic
gaggtgcagctggtggagtctgggggaggcttggtacagcctggcaggtccctgagactctcctgtgcagcctctggattcacctttgatgaatatgccatgcactgggtccggcaagttccagggaagggcctggagtgggtctcaggtattagttgggatggtggtaacataggctatgcggactctgtgaagggccgattcaccatctccagagacaacgccaagaactccctgtatctgcaaatgaacagtctgagacctgaggacacggccttgtattactgttcaaaagatattgtactagtaccaactggggactactactactacgctatggacgtctggggccaagggaccacggtcaccgtctcctca

SEQ ID NO: 2154 - protein, 126 aa, Artificial Sequence
  synthetic
EVQLVESGGGLVQPGRSLRLSCAASGFTFDEYAMHWVRQVPGKGLEWVSGISWDGGNIGYADSVKGRFTISRDNAKNSLYLQMNSLRPEDTALYYCSKDIVLVPTGDYYYYAMDVWGQGTTVTVSS

SEQ ID NO: 2155 - DNA, 24 bp, Artificial Sequence
  synthetic
ggattcacctttgatgaatatgcc

SEQ ID NO: 2156 - protein, 8 aa, Artificial Sequence
  synthetic
GFTFDEYA

SEQ ID NO: 2157 - DNA, 24 bp, Artificial Sequence
  synthetic
attagttgggatggtggtaacata

SEQ ID NO: 2158 - protein, 8 aa, Artificial Sequence
  synthetic
ISWDGGNI

SEQ ID NO: 2159 - DNA, 57 bp, Artificial Sequence
  synthetic
tcaaaagatattgtactagtaccaactggggactactactactacgctatggacgtc

SEQ ID NO: 2160 - protein, 19 aa, Artificial Sequence
  synthetic
SKDIVLVPTGDYYYYAMDV

SEQ ID NO: 2161 - DNA, 324 bp, Artificial Sequence
  synthetic
gacatccagatgacccagtctccatcttccgtgtctgcatctgtaggagacagagtcaccatcacttgtcgggcgagtcagggtattatcagctggttagcctggtatcagcagaaaccagggaaagcccctaacctcctgatctatgctgcatccagtttgcaaagtggggtcccatcaaggttcagcggcagtggatctgggacagatttcactctcaccatcagcaacctgcagcctgaagattttgcaacttactattgtcaacaggctaacagtttcccattcactttcggccctgggaccaaggtggagatcaaacga

SEQ ID NO: 2162 - protein, 108 aa, Artificial Sequence
  synthetic
DIQMTQSPSSVSASVGDRVTITCRASQGIISWLAWYQQKPGKAPNLLIYAASSLQSGVPSRFSGSGSGTDFTLTISNLQPEDFATYYCQQANSFPFTFGPGTKVEIKR

SEQ ID NO: 2163 - DNA, 18 bp, Artificial Sequence
  synthetic
cagggtattatcagctgg

SEQ ID NO: 2164 - protein, 6 aa, Artificial Sequence
  synthetic
QGIISW

SEQ ID NO: 2165 - DNA, 9 bp, Artificial Sequence
  synthetic
gctgcatcc

SEQ ID NO: 2166 - protein, 3 aa, Artificial Sequence
  synthetic
AAS

SEQ ID NO: 2167 - DNA, 27 bp, Artificial Sequence
  synthetic
caacaggctaacagtttcccattcact

SEQ ID NO: 2168 - protein, 9 aa, Artificial Sequence
  synthetic
QQANSFPFT

SEQ ID NO: 2169 - DNA, 366 bp, Artificial Sequence
  synthetic
gaggtgcagctggtggagtctggagcagaggtgaaaaagcccggggagtctctgaagatctcctgtaaggtttctggatacaacttttccaaatactggatcggctgggtgcgccagatgcccgggaaaggcctagagtggatgggattcatctatcctggtgactctgataccagatacagcccgtccttccaaggccaggtcaccctctcagccgacaagtccatcaacaccgcctacctgcagtggaacagcctgaaggcctcggacaccgccatgtacttctgtgcgagacaggggagatatatatctgcagctggtaattttgactactggggccagggaaccctggtcaccgtctcctca

SEQ ID NO: 2170 - protein, 122 aa, Artificial Sequence
  synthetic
EVQLVESGAEVKKPGESLKISCKVSGYNFSKYWIGWVRQMPGKGLEWMGFIYPGDSDTRYSPSFQGQVTLSADKSINTAYLQWNSLKASDTAMYFCARQGRYISAAGNFDYWGQGTLVTVSS

SEQ ID NO: 2171 - DNA, 24 bp, Artificial Sequence
  synthetic
ggatacaacttttccaaatactgg

SEQ ID NO: 2172 - protein, 8 aa, Artificial Sequence
  synthetic
GYNFSKYW

SEQ ID NO: 2173 - DNA, 24 bp, Artificial Sequence
  synthetic
atctatcctggtgactctgatacc

SEQ ID NO: 2174 - protein, 8 aa, Artificial Sequence
  synthetic
IYPGDSDT

SEQ ID NO: 2175 - DNA, 45 bp, Artificial Sequence
  synthetic
gcgagacaggggagatatatatctgcagctggtaattttgactac

SEQ ID NO: 2176 - protein, 15 aa, Artificial Sequence
  synthetic
ARQGRYISAAGNFDY

SEQ ID NO: 2177 - DNA, 324 bp, Artificial Sequence
  synthetic
gacatcctgatgacccagtctccatcctccctgtctgcatctgtaggagacagagtcaccatcacttgccgggcaagtcagagcattagcacctatttaaattggtatcaacagaaaccagggaaagcccctaaggtcctgatctatgctgtatccaatttacaaagtggggtcccatcaaggttcagtggcagtggctctgagacagatttcactctcaccatcagcagtctgcaacctgaagattttgcaacttacttctgtcaacagacttacagtctcccgctcactttcggcggagggaccaaggtggagatcaaacga

SEQ ID NO: 2178 - protein, 108 aa, Artificial Sequence
  synthetic
DILMTQSPSSLSASVGDRVTITCRASQSISTYLNWYQQKPGKAPKVLIYAVSNLQSGVPSRFSGSGSETDFTLTISSLQPEDFATYFCQQTYSLPLTFGGGTKVEIKR

SEQ ID NO: 2179 - DNA, 18 bp, Artificial Sequence
  synthetic
cagagcattagcacctat

SEQ ID NO: 2180 - protein, 6 aa, Artificial Sequence
  synthetic
QSISTY

SEQ ID NO: 2181 - DNA, 9 bp, Artificial Sequence
  synthetic
gctgtatcc

SEQ ID NO: 2182 - protein, 3 aa, Artificial Sequence
  synthetic
AVS

SEQ ID NO: 2183 - DNA, 27 bp, Artificial Sequence
  synthetic
caacagacttacagtctcccgctcact

SEQ ID NO: 2184 - protein, 9 aa, Artificial Sequence
  synthetic
QQTYSLPLT

SEQ ID NO: 2185 - DNA, 366 bp, Artificial Sequence
  synthetic
gaggtgcagctggtggagtcgggcccaggactggtgaagccttcggagaccctgtccctcacctgcactgtctctggtggctccattagtagttactactggagctggatccgacagtccccagggaagggactggagtggattggctatatctattacagtgggaggaccaattataatccctctctcaagagtcgggtcaccatatcagtagactcgtccaagaatcagttctccctgaagctgagctctgtgaccgctgcggacacggccgtgtattactgtgcgaggggggctagttcttctgactactactatttcggtatggacgtctggggccaagggaccacggtcaccgtctcctca

SEQ ID NO: 2186 - protein, 122 aa, Artificial Sequence
  synthetic
EVQLVESGPGLVKPSETLSLTCTVSGGSISSYYWSWIRQSPGKGLEWIGYIYYSGRTNYNPSLKSRVTISVDSSKNQFSLKLSSVTAADTAVYYCARGASSSDYYYFGMDVWGQGTTVTVSS

SEQ ID NO: 2187 - DNA, 24 bp, Artificial Sequence
  synthetic
ggtggctccattagtagttactac

SEQ ID NO: 2188 - protein, 8 aa, Artificial Sequence
  synthetic
GGSISSYY

SEQ ID NO: 2189 - DNA, 21 bp, Artificial Sequence
  synthetic
atctattacagtgggaggacc

SEQ ID NO: 2190 - protein, 7 aa, Artificial Sequence
  synthetic
IYYSGRT

SEQ ID NO: 2191 - DNA, 48 bp, Artificial Sequence
  synthetic
gcgaggggggctagttcttctgactactactatttcggtatggacgtc

SEQ ID NO: 2192 - protein, 16 aa, Artificial Sequence
  synthetic
ARGASSSDYYYFGMDV

SEQ ID NO: 2193 - DNA, 342 bp, Artificial Sequence
  synthetic
gacatcctgatgacccagtctccagactccctggctgtgtctctgggcgagagggccaccatcaactgcaagtccagccagaatattttatacagctccaacactaagacctacttagcttggtaccagcagaaaccagggcagcctcctaaactgctcatttactgggcatctacccgggaatcctgggtccctgaccgattcagtggcagcgggtctgggacagatttcactctcaccatcagcagcctgctgactgaagatgtggcaatttatttctgtcaacaatactataatactccgtggacgttcggccaagggaccaaggtggagatcaaacga

SEQ ID NO: 2194 - protein, 114 aa, Artificial Sequence
  synthetic
DILMTQSPDSLAVSLGERATINCKSSQNILYSSNTKTYLAWYQQKPGQPPKLLIYWASTRESWVPDRFSGSGSGTDFTLTISSLLTEDVAIYFCQQYYNTPWTFGQGTKVEIKR

SEQ ID NO: 2195 - DNA, 36 bp, Artificial Sequence
  synthetic
cagaatattttatacagctccaacactaagacctac

SEQ ID NO: 2196 - protein, 12 aa, Artificial Sequence
  synthetic
QNILYSSNTKTY

SEQ ID NO: 2197 - DNA, 9 bp, Artificial Sequence
  synthetic
tgggcatct

SEQ ID NO: 2198 - protein, 3 aa, Artificial Sequence
  synthetic
WAS

SEQ ID NO: 2199 - DNA, 27 bp, Artificial Sequence
  synthetic
caacaatactataatactccgtggacg

SEQ ID NO: 2200 - protein, 9 aa, Artificial Sequence
  synthetic
QQYYNTPWT

SEQ ID NO: 2201 - DNA, 363 bp, Artificial Sequence
  synthetic
gaggtgcagctggtggagtctgggggagaattggtacagcctggcaggtccctgagactctcctgtgcagcctctggattcacctttgatgattatgacatgcactgggtccggcaagctccagggaatggcctggagtgggtctcaggtattagttggaatagtggtagtataggctatgcggactctgtgaagggccgattcaccatctccagagacaacgccaagaactccctgtatctgcaaatgaacagtctgagagctgaggacacggccttgtattactgtgcaaaaaatgtggatatagtggccccctacggtatggacgtctggggccaagggaccacggtcaccgtctcctca

SEQ ID NO: 2202 - protein, 121 aa, Artificial Sequence
  synthetic
EVQLVESGGELVQPGRSLRLSCAASGFTFDDYDMHWVRQAPGNGLEWVSGISWNSGSIGYADSVKGRFTISRDNAKNSLYLQMNSLRAEDTALYYCAKNVDIVAPYGMDVWGQGTTVTVSS

SEQ ID NO: 2203 - DNA, 24 bp, Artificial Sequence
  synthetic
ggattcacctttgatgattatgac

SEQ ID NO: 2204 - protein, 8 aa, Artificial Sequence
  synthetic
GFTFDDYD

SEQ ID NO: 2205 - DNA, 24 bp, Artificial Sequence
  synthetic
attagttggaatagtggtagtata

SEQ ID NO: 2206 - protein, 8 aa, Artificial Sequence
  synthetic
ISWNSGSI

SEQ ID NO: 2207 - DNA, 42 bp, Artificial Sequence
  synthetic
gcaaaaaatgtggatatagtggccccctacggtatggacgtc

SEQ ID NO: 2208 - protein, 14 aa, Artificial Sequence
  synthetic
AKNVDIVAPYGMDV

SEQ ID NO: 2209 - DNA, 324 bp, Artificial Sequence
  synthetic
gacatcctgatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcactatggtagctcatacacttttggccaggggaccaaggtggagatcaaacga

SEQ ID NO: 2210 - protein, 108 aa, Artificial Sequence
  synthetic
DILMTQSPGTLSLSPGERATLSCRASQSVSSSYLAWYQQKPGQAPRLLIYGASSRATGIPDRFSGSGSGTDFTLTISRLEPEDFAVYYCQHYGSSYTFGQGTKVEIKR

SEQ ID NO: 2211 - DNA, 21 bp, Artificial Sequence
  synthetic
cagagtgttagcagcagctac

SEQ ID NO: 2212 - protein, 7 aa, Artificial Sequence
  synthetic
QSVSSSY

SEQ ID NO: 2213 - DNA, 9 bp, Artificial Sequence
  synthetic
ggtgcatcc

SEQ ID NO: 2214 - protein, 3 aa, Artificial Sequence
  synthetic
GAS

SEQ ID NO: 2215 - DNA, 24 bp, Artificial Sequence
  synthetic
cagcactatggtagctcatacact

SEQ ID NO: 2216 - protein, 8 aa, Artificial Sequence
  synthetic
QHYGSSYT

SEQ ID NO: 2217 - DNA, 369 bp, Artificial Sequence
  synthetic
gaggtgcagctggtggagtctgggggaggcttggtacagcctggcaggtccctgagactctcctgtgcagcctctggaatcacctttgatgattatgccatgcactgggtccggcaaggtccagggaagggcctggagtgggtctcaggtattagttggaatagtggtaatataggctatgcggactctgtgaagggccgattcaccatctccagagacaacgccaagaaatccctgtatctgcaaatgaatagtctgagagctgaggacacggccttgtattactgtgcaaaagatatagcagcagctggtctttactactacggtatggacgtctggggccaagggaccacggtcaccgtctcctca

SEQ ID NO: 2218 - protein, 123 aa, Artificial Sequence
  synthetic
EVQLVESGGGLVQPGRSLRLSCAASGITFDDYAMHWVRQGPGKGLEWVSGISWNSGNIGYADSVKGRFTISRDNAKKSLYLQMNSLRAEDTALYYCAKDIAAAGLYYYGMDVWGQGTTVTVSS

SEQ ID NO: 2219 - DNA, 24 bp, Artificial Sequence
  synthetic
ggaatcacctttgatgattatgcc

SEQ ID NO: 2220 - protein, 8 aa, Artificial Sequence
  synthetic
GITFDDYA

SEQ ID NO: 2221 - DNA, 24 bp, Artificial Sequence
  synthetic
attagttggaatagtggtaatata

SEQ ID NO: 2222 - protein, 8 aa, Artificial Sequence
  synthetic
ISWNSGNI

SEQ ID NO: 2223 - DNA, 48 bp, Artificial Sequence
  synthetic
gcaaaagatatagcagcagctggtctttactactacggtatggacgtc

SEQ ID NO: 2224 - protein, 16 aa, Artificial Sequence
  synthetic
AKDIAAAGLYYYGMDV

SEQ ID NO: 2225 - DNA, 324 bp, Artificial Sequence
  synthetic
gacatcctgatgacccagtctccatcctccctgtctgcatctgtaggagacagagtcaccatcacttgccgggcaagtcaggacattagaaatgctttaggctggtatcatcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacaggttaatagttacccattcactttcggccctgggaccaaggtggagatcaaacga

SEQ ID NO: 2226 - protein, 108 aa, Artificial Sequence
  synthetic
DILMTQSPSSLSASVGDRVTITCRASQDIRNALGWYHQKPGKAPKRLIYAASSLQSGVPSRFSGSGSGTEFTLTISSLQPEDFATYYCLQVNSYPFTFGPGTKVEIKR

SEQ ID NO: 2227 - DNA, 18 bp, Artificial Sequence
  synthetic
caggacattagaaatgct

SEQ ID NO: 2228 - protein, 6 aa, Artificial Sequence
  synthetic
QDIRNA

SEQ ID NO: 2229 - DNA, 9 bp, Artificial Sequence
  synthetic
gctgcatcc

SEQ ID NO: 2230 - protein, 3 aa, Artificial Sequence
  synthetic
AAS

SEQ ID NO: 2231 - DNA, 27 bp, Artificial Sequence
  synthetic
ctacaggttaatagttacccattcact

SEQ ID NO: 2232 - protein, 9 aa, Artificial Sequence
  synthetic
LQVNSYPFT

SEQ ID NO: 2233 - DNA, 363 bp, Artificial Sequence
  synthetic
gaggtgcagctggtggagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatattataggtttaagtggtataatgattatgcagtatctgtgaaaagtcgaataaccatcaacccagacacatccaagaaccagttctccctgcagttgaactctgtgactcccgaggacacggctgtgtattactgtgcaagtggggactggaactatcactttgactactggggccagggaaccctggtcaccgtctcctca

SEQ ID NO: 2234 - protein, 121 aa, Artificial Sequence
  synthetic
EVQLVESGPGLVKPSQTLSLTCAISGDSVSSNSAAWNWIRQSPSRGLEWLGRTYYRFKWYNDYAVSVKSRITINPDTSKNQFSLQLNSVTPEDTAVYYCASGDWNYHFDYWGQGTLVTVSS

SEQ ID NO: 2235 - DNA, 30 bp, Artificial Sequence
  synthetic
ggggacagtgtctctagcaacagtgctgct

SEQ ID NO: 2236 - protein, 10 aa, Artificial Sequence
  synthetic
GDSVSSNSAA

SEQ ID NO: 2237 - DNA, 27 bp, Artificial Sequence
  synthetic
acatattataggtttaagtggtataat

SEQ ID NO: 2238 - protein, 9 aa, Artificial Sequence
  synthetic
TYYRFKWYN

SEQ ID NO: 2239 - DNA, 33 bp, Artificial Sequence
  synthetic
gcaagtggggactggaactatcactttgactac

SEQ ID NO: 2240 - protein, 11 aa, Artificial Sequence
  synthetic
ASGDWNYHFDY

SEQ ID NO: 2241 - DNA, 324 bp, Artificial Sequence
  synthetic
gacatccagatgacccagtctccatcctccctgtctgcatctgtaggagacagagtcaccatcacttgccgggcaagtcagagcattagcaactatttaaattggtatcagcagaaaccagggaaagcccctaacctcctgatctatgctgcatccaatttacaaattggggtcccatcaaggttcagtggcagtggatctgggacagatttcactctcaccatcaacagtctgcaacctgaagattttgcagcttactactgtcaacagagttacagaaccccgtacacttttggcctggggaccaaggtggagatcaaacga

SEQ ID NO: 2242 - protein, 108 aa, Artificial Sequence
  synthetic
DIQMTQSPSSLSASVGDRVTITCRASQSISNYLNWYQQKPGKAPNLLIYAASNLQIGVPSRFSGSGSGTDFTLTINSLQPEDFAAYYCQQSYRTPYTFGLGTKVEIKR

SEQ ID NO: 2243 - DNA, 18 bp, Artificial Sequence
  synthetic
cagagcattagcaactat

SEQ ID NO: 2244 - protein, 6 aa, Artificial Sequence
  synthetic
QSISNY

SEQ ID NO: 2245 - DNA, 9 bp, Artificial Sequence
  synthetic
gctgcatcc

SEQ ID NO: 2246 - protein, 3 aa, Artificial Sequence
  synthetic
AAS

SEQ ID NO: 2247 - DNA, 27 bp, Artificial Sequence
  synthetic
caacagagttacagaaccccgtacact

SEQ ID NO: 2248 - protein, 9 aa, Artificial Sequence
  synthetic
QQSYRTPYT

SEQ ID NO: 2249 - DNA, 384 bp, Artificial Sequence
  synthetic
caggtgcagctggtggagtcgggcccaggactggtgaagccttcggagaccctgtccctcacctgcactgtctctggtggctccatcagtaattactactggagctggatccggcagcacccagggaagggactggagtggattgggtatatctattacagtgggagcaccaactacaaaccctccctcaagagtcgagtcaccatatcagtagacacgtccaagaaccagttctccctgaagctgagttctgtgaccgctgcggacacggccgtgtattactgtgcgagagataccattgattactatggttcggggagttcaagctactactactacggtatggacatctggggccaagggaccacggtcaccgtctcctca

SEQ ID NO: 2250 - protein, 128 aa, Artificial Sequence
  synthetic
QVQLVESGPGLVKPSETLSLTCTVSGGSISNYYWSWIRQHPGKGLEWIGYIYYSGSTNYKPSLKSRVTISVDTSKNQFSLKLSSVTAADTAVYYCARDTIDYYGSGSSSYYYYGMDIWGQGTTVTVSS

SEQ ID NO: 2251 - DNA, 24 bp, Artificial Sequence
  synthetic
ggtggctccatcagtaattactac

SEQ ID NO: 2252 - protein, 8 aa, Artificial Sequence
  synthetic
GGSISNYY

SEQ ID NO: 2253 - DNA, 21 bp, Artificial Sequence
  synthetic
atctattacagtgggagcacc

SEQ ID NO: 2254 - protein, 7 aa, Artificial Sequence
  synthetic
IYYSGST

SEQ ID NO: 2255 - DNA, 66 bp, Artificial Sequence
  synthetic
gcgagagataccattgattactatggttcggggagttcaagctactactactacggtatggacatc

SEQ ID NO: 2256 - protein, 22 aa, Artificial Sequence
  synthetic
ARDTIDYYGSGSSSYYYYGMDI

SEQ ID NO: 2257 - DNA, 339 bp, Artificial Sequence
  synthetic
gacatcgtgatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcggagtggaggctgaggatgttggggtttattactgcatgcaatctctacaaagtccgtggacgttcggccaagggaccaaggtggaaatcaaacga

SEQ ID NO: 2258 - protein, 113 aa, Artificial Sequence
  synthetic
DIVMTQSPLSLPVTPGEPASISCRSSQSLLHSNGYNYLDWYLQKPGQSPQLLIYLGSNRASGVPDRFSGSGSGTDFTLKISGVEAEDVGVYYCMQSLQSPWTFGQGTKVEIKR

SEQ ID NO: 2259 - DNA, 33 bp, Artificial Sequence
  synthetic
cagagcctcctgcatagtaatggatacaactat

SEQ ID NO: 2260 - protein, 11 aa, Artificial Sequence
  synthetic
QSLLHSNGYNY

SEQ ID NO: 2261 - DNA, 9 bp, Artificial Sequence
  synthetic
ttgggttct

SEQ ID NO: 2262 - protein, 3 aa, Artificial Sequence
  synthetic
LGS

SEQ ID NO: 2263 - DNA, 27 bp, Artificial Sequence
  synthetic
atgcaatctctacaaagtccgtggacg

SEQ ID NO: 2264 - protein, 9 aa, Artificial Sequence
  synthetic
MQSLQSPWT

SEQ ID NO: 2265 - DNA, 378 bp, Artificial Sequence
  synthetic
caggtgcagctggtggagtctggtcctacgctggtgaaacccacacagaacctcacgctgacctgcaccttctctgggttctcactcaccactagtggagtgggtgtgggctggatccgtcagcccccaggaaaggccctggagtggcttggaatcatttattggaatgatgataaacgctacagcccatctctaaagagcaggctcaccatcagcaaggacacctccaaaaaccaggtggtccttacaatgaccaacatggaccctgtggacacagccacatattactgtgcacacagaagttatagcagtaactggccctactactactacggtatggacatttggggccaagggaccacggtcaccgtctcctca

SEQ ID NO: 2266 - protein, 126 aa, Artificial Sequence
  synthetic
QVQLVESGPTLVKPTQNLTLTCTFSGFSLTTSGVGVGWIRQPPGKALEWLGIIYWNDDKRYSPSLKSRLTISKDTSKNQVVLTMTNMDPVDTATYYCAHRSYSSNWPYYYYGMDIWGQGTTVTVSS

SEQ ID NO: 2267 - DNA, 30 bp, Artificial Sequence
  synthetic
gggttctcactcaccactagtggagtgggt

SEQ ID NO: 2268 - protein, 10 aa, Artificial Sequence
  synthetic
GFSLTTSGVG

SEQ ID NO: 2269 - DNA, 21 bp, Artificial Sequence
  synthetic
atttattggaatgatgataaa

SEQ ID NO: 2270 - protein, 7 aa, Artificial Sequence
  synthetic
IYWNDDK

SEQ ID NO: 2271 - DNA, 54 bp, Artificial Sequence
  synthetic
gcacacagaagttatagcagtaactggccctactactactacggtatggacatt

SEQ ID NO: 2272 - protein, 18 aa, Artificial Sequence
  synthetic
AHRSYSSNWPYYYYGMDI

SEQ ID NO: 2273 - DNA, 324 bp, Artificial Sequence
  synthetic
gacatcctgatgacccagtctccctcttccgtgtctgcatctgttggagacagagtcaccatcacttgtcgggcgagtcagggtattaagaactggttagcctggtatcagcagaaaccagggaaagcccctaggctcctgatctatgattcatccagtttgcaaagtggggtctcatcaaggttcagcggcagtggatttgggacagatttcactctcaccatcagcagcctgcagcctgaagattttgcaacttactattgtcaacaggctaacactttcccattcactttcggccctgggaccaaggtggagatcaaacga

SEQ ID NO: 2274 - protein, 108 aa, Artificial Sequence
  synthetic
DILMTQSPSSVSASVGDRVTITCRASQGIKNWLAWYQQKPGKAPRLLIYDSSSLQSGVSSRFSGSGFGTDFTLTISSLQPEDFATYYCQQANTFPFTFGPGTKVEIKR

SEQ ID NO: 2275 - DNA, 18 bp, Artificial Sequence
  synthetic
cagggtattaagaactgg

SEQ ID NO: 2276 - protein, 6 aa, Artificial Sequence
  synthetic
QGIKNW

SEQ ID NO: 2277 - DNA, 9 bp, Artificial Sequence
  synthetic
gattcatcc

SEQ ID NO: 2278 - protein, 3 aa, Artificial Sequence
  synthetic
DSS

SEQ ID NO: 2279 - DNA, 27 bp, Artificial Sequence
  synthetic
caacaggctaacactttcccattcact

SEQ ID NO: 2280 - protein, 9 aa, Artificial Sequence
  synthetic
QQANTFPFT

SEQ ID NO: 2281 - DNA, 378 bp, Artificial Sequence
  synthetic
caggtgcagctggtggagtctggtcctacgctcgtgaaacccactcagaacctcacgctgacctgcaccttctctgggttctcactcaccactactggagtgggtgtgggctggatccgtcagcccccaggaaaggccctggagtggcttgcaatcatttattggaatgatgataaacgctacagcccatctctaaagagcagggtcaccatcagcaaggacacctccaaaaaccaggtggtccttacaatgaccaacatggaccctgtggacacagccacatattactgtgcacacagaagttatagcagtagctggccctactactactacggtatggacgtttggggccaagggaccacggtcaccgtctcctca

SEQ ID NO: 2282 - protein, 126 aa, Artificial Sequence
  synthetic
QVQLVESGPTLVKPTQNLTLTCTFSGFSLTTTGVGVGWIRQPPGKALEWLAIIYWNDDKRYSPSLKSRVTISKDTSKNQVVLTMTNMDPVDTATYYCAHRSYSSSWPYYYYGMDVWGQGTTVTVSS

SEQ ID NO: 2283 - DNA, 30 bp, Artificial Sequence
  synthetic
gggttctcactcaccactactggagtgggt

SEQ ID NO: 2284 - protein, 10 aa, Artificial Sequence
  synthetic
GFSLTTTGVG

SEQ ID NO: 2285 - DNA, 21 bp, Artificial Sequence
  synthetic
atttattggaatgatgataaa

SEQ ID NO: 2286 - protein, 7 aa, Artificial Sequence
  synthetic
IYWNDDK

SEQ ID NO: 2287 - DNA, 54 bp, Artificial Sequence
  synthetic
gcacacagaagttatagcagtagctggccctactactactacggtatggacgtt

SEQ ID NO: 2288 - protein, 18 aa, Artificial Sequence
  synthetic
AHRSYSSSWPYYYYGMDV

SEQ ID NO: 2289 - DNA, 324 bp, Artificial Sequence
  synthetic
gacatccagatgacccagtctccctcttccgtgtctgcctctgttggagacagagtcaccatcacttgtcgggcgagtcacggtattaggaactggttagcctggtatcagcagaaaccagagaaagcccctaggctcctgatctatgattcatccagtttgcaaagtggggtcccatcaaggttcagcggcggtggatttgggacagatttcactctcaccatcagcagcctgcagcctgaagattttgcaacttactattgtcaacaggctaacactttcccattcactttcggccctgggaccaaggtggagatcaaacga

SEQ ID NO: 2290 - protein, 108 aa, Artificial Sequence
  synthetic
DIQMTQSPSSVSASVGDRVTITCRASHGIRNWLAWYQQKPEKAPRLLIYDSSSLQSGVPSRFSGGGFGTDFTLTISSLQPEDFATYYCQQANTFPFTFGPGTKVEIKR

SEQ ID NO: 2291 - DNA, 18 bp, Artificial Sequence
  synthetic
cacggtattaggaactgg

SEQ ID NO: 2292 - protein, 6 aa, Artificial Sequence
  synthetic
HGIRNW

SEQ ID NO: 2293 - DNA, 9 bp, Artificial Sequence
  synthetic
gattcatcc

SEQ ID NO: 2294 - protein, 3 aa, Artificial Sequence
  synthetic
DSS

SEQ ID NO: 2295 - DNA, 27 bp, Artificial Sequence
  synthetic
caacaggctaacactttcccattcact

SEQ ID NO: 2296 - protein, 9 aa, Artificial Sequence
  synthetic
QQANTFPFT

SEQ ID NO: 2297 - DNA, 366 bp, Artificial Sequence
  synthetic
gaggtgcagctggtggagtcgggcccaggactggtgaagccctcggagaccctgtccctcacctgcactgtctctggtggctccctcagtagttactactggagctggatccggcagttccccgataagggactggagtggattggatttatttattatactggaagcagtgactacaatccctccctcaagagtcgagtcagcatatcagtagacacggccaagaaccagttctccctgaagctgagctctgtgaccgctgcggacacggccatttattactgtggtagagatttttgggcagctcactactactactacggtatcgacgtctggggccaagggaccacggtcaccgtctcctca

SEQ ID NO: 2298 - protein, 122 aa, Artificial Sequence
  synthetic
EVQLVESGPGLVKPSETLSLTCTVSGGSLSSYYWSWIRQFPDKGLEWIGFIYYTGSSDYNPSLKSRVSISVDTAKNQFSLKLSSVTAADTAIYYCGRDFWAAHYYYYGIDVWGQGTTVTVSS

SEQ ID NO: 2299 - DNA, 24 bp, Artificial Sequence
  synthetic
ggtggctccctcagtagttactac

SEQ ID NO: 2300 - protein, 8 aa, Artificial Sequence
  synthetic
GGSLSSYY

SEQ ID NO: 2301 - DNA, 21 bp, Artificial Sequence
  synthetic
atttattatactggaagcagt

SEQ ID NO: 2302 - protein, 7 aa, Artificial Sequence
  synthetic
IYYTGSS

SEQ ID NO: 2303 - DNA, 48 bp, Artificial Sequence
  synthetic
ggtagagatttttgggcagctcactactactactacggtatcgacgtc

SEQ ID NO: 2304 - protein, 16 aa, Artificial Sequence
  synthetic
GRDFWAAHYYYYGIDV

SEQ ID NO: 2305 - DNA, 324 bp, Artificial Sequence
  synthetic
gacatcctgatgacccagtctccatcctccctgtctgcatctgtaggagacagagtcaccatcacttgccgggcaggtcagaccattaccacctttttaaattggtatcagcagagaccagggaaagcccctaaactcctgatctatgctgcatccagtttgcaaagtggggtcccatcaaggttcagtggcagtgattctgggacagatttcactctcaccatcagcagtctgcaacctgaagactttgcaacttactactgtcagcagagttacagtgccccgttcactttcggccctgggaccaaggtggagatcaaacga

SEQ ID NO: 2306 - protein, 108 aa, Artificial Sequence
  synthetic
DILMTQSPSSLSASVGDRVTITCRAGQTITTFLNWYQQRPGKAPKLLIYAASSLQSGVPSRFSGSDSGTDFTLTISSLQPEDFATYYCQQSYSAPFTFGPGTKVEIKR

SEQ ID NO: 2307 - DNA, 18 bp, Artificial Sequence
  synthetic
cagaccattaccaccttt

SEQ ID NO: 2308 - protein, 6 aa, Artificial Sequence
  synthetic
QTITTF

SEQ ID NO: 2309 - DNA, 9 bp, Artificial Sequence
  synthetic
gctgcatcc

SEQ ID NO: 2310 - protein, 3 aa, Artificial Sequence
  synthetic
AAS

SEQ ID NO: 2311 - DNA, 27 bp, Artificial Sequence
  synthetic
cagcagagttacagtgccccgttcact

SEQ ID NO: 2312 - protein, 9 aa, Artificial Sequence
  synthetic
QQSYSAPFT

SEQ ID NO: 2313 - DNA, 378 bp, Artificial Sequence
  synthetic
caggtgcagctggtggagtctggtcctacgctggtgaaacccacacagaccctcacgctgacctgcaccttctctgggttctcattcagtactagtggagtgggtgtgggctggatccgtcagtccccaggaaaggccctggagtggcttgcaatcatttattggaatgatgataagcgctacagcccatctctgaagaccaggctcaccatcaccaaggacacctccaaaaaccaggtggtccttacaatgaccaacatggaccctgtggacacagccacatattactgtgcaaatagaagatatagcagcaactggccctactactactacgggatggacgtctggggccaagggaccacggtcaccgtctcctca

SEQ ID NO: 2314 - protein, 126 aa, Artificial Sequence
  synthetic
QVQLVESGPTLVKPTQTLTLTCTFSGFSFSTSGVGVGWIRQSPGKALEWLAIIYWNDDKRYSPSLKTRLTITKDTSKNQVVLTMTNMDPVDTATYYCANRRYSSNWPYYYYGMDVWGQGTTVTVSS

SEQ ID NO: 2315 - DNA, 30 bp, Artificial Sequence
  synthetic
gggttctcattcagtactagtggagtgggt

SEQ ID NO: 2316 - protein, 10 aa, Artificial Sequence
  synthetic
GFSFSTSGVG

SEQ ID NO: 2317 - DNA, 21 bp, Artificial Sequence
  synthetic
atttattggaatgatgataag

SEQ ID NO: 2318 - protein, 7 aa, Artificial Sequence
  synthetic
IYWNDDK

SEQ ID NO: 2319 - DNA, 54 bp, Artificial Sequence
  synthetic
gcaaatagaagatatagcagcaactggccctactactactacgggatggacgtc

SEQ ID NO: 2320 - protein, 18 aa, Artificial Sequence
  synthetic
ANRRYSSNWPYYYYGMDV

SEQ ID NO: 2321 - DNA, 324 bp, Artificial Sequence
  synthetic
gacatccagatgacccagtctccatcttccgtgtctgcatctgtgggagacagagtcaccatcacttgtcgggcgagtcagggtattcgcaactggttagcctggtatcagcagaaaccagggaaaccccctaagctcctgatctatgatgcatccagtttgcaaagtggggtcccatcaaggttcagcggcagtggatctgggacagatttcactctcaccattaatagcctgcagcctgaagattttgcgacttactattgtcaacaggctaacactttcccattcactttcggccctgggaccaaggtggagatcaaacga

SEQ ID NO: 2322 - protein, 108 aa, Artificial Sequence
  synthetic
DIQMTQSPSSVSASVGDRVTITCRASQGIRNWLAWYQQKPGKPPKLLIYDASSLQSGVPSRFSGSGSGTDFTLTINSLQPEDFATYYCQQANTFPFTFGPGTKVEIKR

SEQ ID NO: 2323 - DNA, 18 bp, Artificial Sequence
  synthetic
cagggtattcgcaactgg

SEQ ID NO: 2324 - protein, 6 aa, Artificial Sequence
  synthetic
QGIRNW

SEQ ID NO: 2325 - DNA, 9 bp, Artificial Sequence
  synthetic
gatgcatcc

SEQ ID NO: 2326 - protein, 3 aa, Artificial Sequence
  synthetic
DAS

SEQ ID NO: 2327 - DNA, 27 bp, Artificial Sequence
  synthetic
caacaggctaacactttcccattcact

SEQ ID NO: 2328 - protein, 9 aa, Artificial Sequence
  synthetic
QQANTFPFT

SEQ ID NO: 2329 - DNA, 378 bp, Artificial Sequence
  synthetic
caggtgcagctggtggagtctggtcctacgctggtgaaacccacacagaccctcacgctgacctgcaccttctctgggttctcactcagcactagtggagtgggtgtgggctggatccgtcagcccccaggaaaggccctggagtggcttggaatcatttattggaatgatgataagcgctacagcccatctctgaagagcagagtcaccatcaccaaggacacctccaaaaaccaggtggtccttacaatgaccaacatggaccctgtggacacagccacatattactgtgcacacagaagttatagcagcaactggccctactactactacggtatgaacgtctggggccaagggaccacggtcaccgtctcctca

SEQ ID NO: 2330 - protein, 126 aa, Artificial Sequence
  synthetic
QVQLVESGPTLVKPTQTLTLTCTFSGFSLSTSGVGVGWIRQPPGKALEWLGIIYWNDDKRYSPSLKSRVTITKDTSKNQVVLTMTNMDPVDTATYYCAHRSYSSNWPYYYYGMNVWGQGTTVTVSS

SEQ ID NO: 2331 - DNA, 30 bp, Artificial Sequence
  synthetic
gggttctcactcagcactagtggagtgggt

SEQ ID NO: 2332 - protein, 10 aa, Artificial Sequence
  synthetic
GFSLSTSGVG

SEQ ID NO: 2333 - DNA, 21 bp, Artificial Sequence
  synthetic
atttattggaatgatgataag

SEQ ID NO: 2334 - protein, 7 aa, Artificial Sequence
  synthetic
IYWNDDK

SEQ ID NO: 2335 - DNA, 54 bp, Artificial Sequence
  synthetic
gcacacagaagttatagcagcaactggccctactactactacggtatgaacgtc

SEQ ID NO: 2336 - protein, 18 aa, Artificial Sequence
  synthetic
AHRSYSSNWPYYYYGMNV

SEQ ID NO: 2337 - DNA, 324 bp, Artificial Sequence
  synthetic
gacatccagatgacccagtctccatcttccgtgtctgcctctgtaggagacagagtcaccatcacttgtcgggcgagtcagggtattcgcaactggttagcctggtatcagcagaaaccagggaaagcccccaacctcctgatctatgatgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaggtggagatcaaacga

SEQ ID NO: 2338 - protein, 108 aa, Artificial Sequence
  synthetic
DIQMTQSPSSVSASVGDRVTITCRASQGIRNWLAWYQQKPGKAPNLLIYDASSLQSGVPSRFSGSGSGTDFTLTISSLQPEDFATYYCQQANSFPFTFGPGTKVEIKR

SEQ ID NO: 2339 - DNA, 18 bp, Artificial Sequence
  synthetic
cagggtattcgcaactgg

SEQ ID NO: 2340 - protein, 6 aa, Artificial Sequence
  synthetic
QGIRNW

SEQ ID NO: 2341 - DNA, 9 bp, Artificial Sequence
  synthetic
gatgcatcc

SEQ ID NO: 2342 - protein, 3 aa, Artificial Sequence
  synthetic
DAS

SEQ ID NO: 2343 - DNA, 27 bp, Artificial Sequence
  synthetic
caacaggctaacagtttcccattcact

SEQ ID NO: 2344 - protein, 9 aa, Artificial Sequence
  synthetic
QQANSFPFT

SEQ ID NO: 2345 - DNA, 378 bp, Artificial Sequence
  synthetic
caggtgcagctggtggagtctggtcctacgctggtaaaacccacacagaccctcacgctgacctgcaccttctctgggttctcactcagcactagtggagtgggtgtgggctggatccgtcagcccccaggaaaggccctggagtggcttggaatcatttattggaatgatgataagcgctacaatccatctctgaagagcaggctcaccatcaccaaggacacctccaaaaaccaggtggtccttacaatgaccaacatggaccctgtggacacagccacatattactgtgcacacagagcgtatagcagcagctggccctactacttctacggtatggacgtctggggccaagggaccacggtcaccgtctcctca

SEQ ID NO: 2346 - protein, 126 aa, Artificial Sequence
  synthetic
QVQLVESGPTLVKPTQTLTLTCTFSGFSLSTSGVGVGWIRQPPGKALEWLGIIYWNDDKRYNPSLKSRLTITKDTSKNQVVLTMTNMDPVDTATYYCAHRAYSSSWPYYFYGMDVWGQGTTVTVSS

SEQ ID NO: 2347 - DNA, 30 bp, Artificial Sequence; identical to SEQ ID NO: 2331
  synthetic

SEQ ID NO: 2348 - protein, 10 aa, Artificial Sequence
  synthetic
GFSLSTSGVG

SEQ ID NO: 2349 - DNA, 21 bp, Artificial Sequence
  synthetic
atttattggaatgatgataag

SEQ ID NO: 2350 - protein, 7 aa, Artificial Sequence
  synthetic
IYWNDDK

SEQ ID NO: 2351 - DNA, 54 bp, Artificial Sequence
  synthetic
gcacacagagcgtatagcagcagctggccctactacttctacggtatggacgtc

SEQ ID NO: 2352 - protein, 18 aa, Artificial Sequence
  synthetic
AHRAYSSSWPYYFYGMDV

SEQ ID NO: 2353 - DNA, 324 bp, Artificial Sequence
  synthetic
gacatccagatgacccagtctccatcttccgtgtctgcctctgtaggagacagagtcaccatcacttgtcgggcgagtcagggtattcgcaactggttagcctggtatcagcagaaaccagggaaagtccctaagctcctgatctatgatgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaggtggagatcaaacga

SEQ ID NO: 2354 - protein, 108 aa, Artificial Sequence
  synthetic
DIQMTQSPSSVSASVGDRVTITCRASQGIRNWLAWYQQKPGKVPKLLIYDASSLQSGVPSRFSGSGSGTDFTLTISSLQPEDFATYYCQQANSFPFTFGPGTKVEIKR

SEQ ID NO: 2355 - DNA, 18 bp, Artificial Sequence
  synthetic
cagggtattcgcaactgg

SEQ ID NO: 2356 - protein, 6 aa, Artificial Sequence
  synthetic
QGIRNW

SEQ ID NO: 2357 - DNA, 9 bp, Artificial Sequence
  synthetic
gatgcatcc

SEQ ID NO: 2358 - protein, 3 aa, Artificial Sequence
  synthetic
DAS

SEQ ID NO: 2359 - DNA, 27 bp, Artificial Sequence
  synthetic
caacaggctaacagtttcccattcact

SEQ ID NO: 2360 - protein, 9 aa, Artificial Sequence
  synthetic
QQANSFPFT

SEQ ID NO: 2361 - DNA, 378 bp, Artificial Sequence
  synthetic
gaggtgcagctggtggagtctgggggaggcttggtacagcctggggggtccctgagactctcctgtgtagcctctggattcacctttagcagctattccatgagctgggtccgccaggctccagggaaggggctagagtgggtctcaactattagtggtagtggtaatagtatattctacgcagactccgtgaagggccggttcaccatctccagagacaattccaagagcacgctatatctacaaatgaatagtctgagagtcgaggacacggccgtatattactgtgcaattgtagcagctcgtcgggaggcccatttctactactactacaatatggacgtctggggccaagggaccacggtcaccgtctcctca

SEQ ID NO: 2362 - protein, 126 aa, Artificial Sequence
  synthetic
EVQLVESGGGLVQPGGSLRLSCVASGFTFSSYSMSWVRQAPGKGLEWVSTISGSGNSIFYADSVKGRFTISRDNSKSTLYLQMNSLRVEDTAVYYCAIVAARREAHFYYYYNMDVWGQGTTVTVSS

SEQ ID NO: 2363 - DNA, 24 bp, Artificial Sequence
  synthetic
ggattcacctttagcagctattcc

SEQ ID NO: 2364 - protein, 8 aa, Artificial Sequence
  synthetic
GFTFSSYS

SEQ ID NO: 2365 - DNA, 24 bp, Artificial Sequence
  synthetic
attagtggtagtggtaatagtata

SEQ ID NO: 2366 - protein, 8 aa, Artificial Sequence
  synthetic
ISGSGNSI

SEQ ID NO: 2367 - DNA, 57 bp, Artificial Sequence
  synthetic
gcaattgtagcagctcgtcgggaggcccatttctactactactacaatatggacgtc

SEQ ID NO: 2368 - protein, 19 aa, Artificial Sequence
  synthetic
AIVAARREAHFYYYYNMDV

SEQ ID NO: 2369 - DNA, 324 bp, Artificial Sequence
  synthetic
gacatccagatgacccagtctccatcctcactgtctgcatctgcaggagacagagtcaccatcacttgtcgggcgagtcagggcattagtaattatttagcctggtttcagcagaaaccagggaaagcccctaagtccctgatctatgctgcatccagtttgcaaagtgggatcccatcaaaattcagcggcagtggatctgggacagatttcactctcaccatcagcaacctgcagcctgaagattttgcaacttattactgccaacagtataatgattaccctctcactttcggcggagggaccaaggtggagatcaaacga

SEQ ID NO: 2370 - protein, 108 aa, Artificial Sequence
  synthetic
DIQMTQSPSSLSASAGDRVTITCRASQGISNYLAWFQQKPGKAPKSLIYAASSLQSGIPSKFSGSGSGTDFTLTISNLQPEDFATYYCQQYNDYPLTFGGGTKVEIKR

SEQ ID NO: 2371 - DNA, 18 bp, Artificial Sequence
  synthetic
cagggcattagtaattat

SEQ ID NO: 2372 - protein, 6 aa, Artificial Sequence
  synthetic
QGISNY

SEQ ID NO: 2373 - DNA, 9 bp, Artificial Sequence
  synthetic
gctgcatcc

SEQ ID NO: 2374 - protein, 3 aa, Artificial Sequence
  synthetic
AAS

SEQ ID NO: 2375 - DNA, 27 bp, Artificial Sequence
  synthetic
caacagtataatgattaccctctcact

SEQ ID NO: 2376 - protein, 9 aa, Artificial Sequence
  synthetic
QQYNDYPLT

SEQ ID NO: 2377 - DNA, 366 bp, Artificial Sequence
  synthetic
gaggtgcagctggtggagtctgggggaggcttggtacagcctggcaggtccctgagactatcctgtgcagcctctggattcacctttgatgattatgccatgcactgggtccggcaagctccagggaagggcctggagtgggtctcaggtattagttggaatagtggtagcataggctatgcggactctgtgaagggccgattcatcatctccagagacaacgccaagaactccctgtatctgcaaatggacagtctgagatctgaggacacggccttatattactgtgcaagagttcttacctggaacttcgtttatgatgcttttgacatctggggccaagggacaatggtcaccgtctcttca

SEQ ID NO: 2378 - protein, 122 aa, Artificial Sequence
  synthetic
EVQLVESGGGLVQPGRSLRLSCAASGFTFDDYAMHWVRQAPGKGLEWVSGISWNSGSIGYADSVKGRFIISRDNAKNSLYLQMDSLRSEDTALYYCARVLTWNFVYDAFDIWGQGTMVTVSS

SEQ ID NO: 2379 - DNA, 24 bp, Artificial Sequence
  synthetic
ggattcacctttgatgattatgcc

SEQ ID NO: 2380 - protein, 8 aa, Artificial Sequence
  synthetic
GFTFDDYA

SEQ ID NO: 2381 - DNA, 24 bp, Artificial Sequence
  synthetic
attagttggaatagtggtagcata

SEQ ID NO: 2382 - protein, 8 aa, Artificial Sequence
  synthetic
ISWNSGSI

SEQ ID NO: 2383 - DNA, 45 bp, Artificial Sequence
  synthetic
gcaagagttcttacctggaacttcgtttatgatgcttttgacatc

SEQ ID NO: 2384 - protein, 15 aa, Artificial Sequence
  synthetic
ARVLTWNFVYDAFDI

SEQ ID NO: 2385 - DNA, 327 bp, Artificial Sequence
  synthetic
gacatcgtgatgacccagtctccgggcaccctgtctttgtctccaggggaaagagccaccctctcctgcagggccagtcagagtattagcagcacctacttagcctggtaccagcagaaacctggccaggctcccaggctcctcatctatggtacattcagcagggccactggcatcccagacaggttcagtggcagtgggtctgggacagacttcactctcaccatcagcagactggagcctgaagattttgcagtgtattactgtcaccaatatggtagctcaccgtacacttttggccaggggaccaaggtggagatcaaacga

SEQ ID NO: 2386 - protein, 109 aa, Artificial Sequence
  synthetic
DIVMTQSPGTLSLSPGERATLSCRASQSISSTYLAWYQQKPGQAPRLLIYGTFSRATGIPDRFSGSGSGTDFTLTISRLEPEDFAVYYCHQYGSSPYTFGQGTKVEIKR

SEQ ID NO: 2387 - DNA, 21 bp, Artificial Sequence
  synthetic
cagagtattagcagcacctac

SEQ ID NO: 2388 - protein, 7 aa, Artificial Sequence
  synthetic
QSISSTY

SEQ ID NO: 2389 - DNA, 9 bp, Artificial Sequence
  synthetic
ggtacattc

SEQ ID NO: 2390 - protein, 3 aa, Artificial Sequence
  synthetic
GTF

SEQ ID NO: 2391 - DNA, 27 bp, Artificial Sequence
  synthetic
caccaatatggtagctcaccgtacact

SEQ ID NO: 2392 - protein, 9 aa, Artificial Sequence
  synthetic
HQYGSSPYT

SEQ ID NO: 2393 - DNA, 366 bp, Artificial Sequence
  synthetic
gaggtgcagctggtggagtctgggggaggcttggtacagcctggggggtccctgagactcgcctgtgcagcctctggattcacctttagcagctatgccatgatctgggtccgccaggttccagggatggggctggagtgggtctcagctattagtggtagtggtggtaacacatactacgcagactccgtgaagggccggttcaccatctccagagacaattccaagaacacgctgtatctgcaaatgaacagcctgacagccgaggacacggccgtatattactgtgcgaagggagcagctcgtggatactactattacggtatggacgtctggggccaagggaccacggtcaccgtctcctca

SEQ ID NO: 2394 - protein, 122 aa, Artificial Sequence
  synthetic
EVQLVESGGGLVQPGGSLRLACAASGFTFSSYAMIWVRQVPGMGLEWVSAISGSGGNTYYADSVKGRFTISRDNSKNTLYLQMNSLTAEDTAVYYCAKGAARGYYYYGMDVWGQGTTVTVSS

SEQ ID NO: 2395 - DNA, 24 bp, Artificial Sequence
  synthetic
ggattcacctttagcagctatgcc

SEQ ID NO: 2396 - protein, 8 aa, Artificial Sequence
  synthetic
GFTFSSYA

SEQ ID NO: 2397 - DNA, 24 bp, Artificial Sequence
  synthetic
attagtggtagtggtggtaacaca

SEQ ID NO: 2398 - protein, 8 aa, Artificial Sequence
  synthetic
ISGSGGNT

SEQ ID NO: 2399 - DNA, 45 bp, Artificial Sequence
  synthetic
gcgaagggagcagctcgtggatactactattacggtatggacgtc

SEQ ID NO: 2400 - protein, 15 aa, Artificial Sequence
  synthetic
AKGAARGYYYYGMDV

SEQ ID NO: 2401 - DNA, 324 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaaactcctgatctatggtgcgtccagtttacaaagtggggtcccatcaaggttcagcggcagtggatctggcacagatttcactctcaccatcagcagcctgcagcctgaagattttgcaacttattactgtctacaagattacaattacccattcactttcggccctgggaccaaggtggagatcaaacga

SEQ ID NO: 2402 - protein, 108 aa, Artificial Sequence
  synthetic
DIQMTQSPSSLSASVGDRVTITCRASQGIRNDLGWYQQKPGKAPKLLIYGASSLQSGVPSRFSGSGSGTDFTLTISSLQPEDFATYYCLQDYNYPFTFGPGTKVEIKR

SEQ ID NO: 2403 - DNA, 18 bp, Artificial Sequence
  synthetic
cagggcattagaaatgat

SEQ ID NO: 2404 - protein, 6 aa, Artificial Sequence
  synthetic
QGIRND

SEQ ID NO: 2405 - DNA, 9 bp, Artificial Sequence
  synthetic
ggtgcgtcc

SEQ ID NO: 2406 - protein, 3 aa, Artificial Sequence
  synthetic
GAS

SEQ ID NO: 2407 - DNA, 27 bp, Artificial Sequence
  synthetic
ctacaagattacaattacccattcact

SEQ ID NO: 2408 - protein, 9 aa, Artificial Sequence
  synthetic
LQDYNYPFT

SEQ ID NO: 2409 - DNA, 378 bp, Artificial Sequence
  synthetic
caggtgcagctggtggagtctggtcctacgctggtgaaacccacacagaccctcacgctgacctgcaccttctctgggttctcactcagcactagtggagtgggtgtgggctggatccgtcagcccccaggaaaggccctggagtggcttggaatcatttattggaatgatgataagcgctacagcccatctctgaagagcagactcgccatcaccaaggacacctccaaaaaccaggtggtccttacaatgaccaacatggaccctgtggacacagccacatattactgtgcacacagaagttatagcagcaactggccctactactactacggtatgaacgtctggggccaagggaccacggtcaccgtctcctca

SEQ ID NO: 2410 - protein, 126 aa, Artificial Sequence
  synthetic
QVQLVESGPTLVKPTQTLTLTCTFSGFSLSTSGVGVGWIRQPPGKALEWLGIIYWNDDKRYSPSLKSRLAITKDTSKNQVVLTMTNMDPVDTATYYCAHRSYSSNWPYYYYGMNVWGQGTTVTVSS

SEQ ID NO: 2411 - DNA, 30 bp, Artificial Sequence; identical to SEQ ID NO: 2331
  synthetic

SEQ ID NO: 2412 - protein, 10 aa, Artificial Sequence
  synthetic
GFSLSTSGVG

SEQ ID NO: 2413 - DNA, 21 bp, Artificial Sequence
  synthetic
atttattggaatgatgataag

SEQ ID NO: 2414 - protein, 7 aa, Artificial Sequence
  synthetic
IYWNDDK

SEQ ID NO: 2415 - DNA, 54 bp, Artificial Sequence; identical to SEQ ID NO: 2335
  synthetic

SEQ ID NO: 2416 - protein, 18 aa, Artificial Sequence
  synthetic
AHRSYSSNWPYYYYGMNV

SEQ ID NO: 2417 - DNA, 324 bp, Artificial Sequence
  synthetic
gacatccagatgacccagtctccatcttccgtgtctgcctctgtaggagacagagtcaccatcacttgtcgggcgagtcagggtattcgcaattggttagcctggtatcagcagaaaccagggaaagcccccaacctcctgatctatgatgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaggtggagatcaaacga

SEQ ID NO: 2418 - protein, 108 aa, Artificial Sequence; identical to SEQ ID NO: 2338
  synthetic

SEQ ID NO: 2419 - DNA, 18 bp, Artificial Sequence
  synthetic
cagggtattcgcaattgg

SEQ ID NO: 2420 - protein, 6 aa, Artificial Sequence
  synthetic
QGIRNW

SEQ ID NO: 2421 - DNA, 9 bp, Artificial Sequence
  synthetic
gatgcatcc

SEQ ID NO: 2422 - protein, 3 aa, Artificial Sequence
  synthetic
DAS

SEQ ID NO: 2423 - DNA, 27 bp, Artificial Sequence
  synthetic
caacaggctaacagtttcccattcact

SEQ ID NO: 2424 - protein, 9 aa, Artificial Sequence
  synthetic
QQANSFPFT

SEQ ID NO: 2425 - DNA, 375 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccagggtccaggcaaggggctggagtgggtggcacttatatcatatgatggaagtaataaatactatgcagactccgtgaagggccgattcaccatctccagagacaattccaagaacacgctgtatctgcaaatgaacagcctgagagttgaggacacggctctgttttactgtgtgaaagaccgggagatttttggagtggttaggtactactacggtatggacgtctggggccaagggaccacggtcaccgtctcctca

SEQ ID NO: 2426 - protein, 125 aa, Artificial Sequence
  synthetic
QVQLVESGGGVVQPGRSLRLSCAASGFTFSSYGMHWVRQGPGKGLEWVALISYDGSNKYYADSVKGRFTISRDNSKNTLYLQMNSLRVEDTALFYCVKDREIFGVVRYYYGMDVWGQGTTVTVSS

SEQ ID NO: 2427 - DNA, 24 bp, Artificial Sequence
  synthetic
ggattcaccttcagtagctatggc

SEQ ID NO: 2428 - protein, 8 aa, Artificial Sequence
  synthetic
GFTFSSYG

SEQ ID NO: 2429 - DNA, 24 bp, Artificial Sequence
  synthetic
atatcatatgatggaagtaataaa

SEQ ID NO: 2430 - protein, 8 aa, Artificial Sequence
  synthetic
ISYDGSNK

SEQ ID NO: 2431 - DNA, 54 bp, Artificial Sequence
  synthetic
gtgaaagaccgggagatttttggagtggttaggtactactacggtatggacgtc

SEQ ID NO: 2432 - protein, 18 aa, Artificial Sequence
  synthetic
VKDREIFGVVRYYYGMDV

SEQ ID NO: 2433 - DNA, 339 bp, Artificial Sequence
  synthetic
gacatcctgatgacccagtctccactctccctgcccgtcacccctggagagccggcctccatctcctgcaggtctagtcagagcctcctgcatggtaatggatacaactatttggattggtacctgcagaagccagggcagtctccacatctcctgatctatttgggttctaatcgggcctccggggtccctgacaggctcagtggcagtggatcaggcacagattttacactgaaaatcagcagagtggaggctgaggatgttggggtttattactgcatgcaagctctacaaactcctctcactttcggcggagggaccaaggtggagatcaaacga

SEQ ID NO: 2434 - protein, 113 aa, Artificial Sequence
  synthetic
DILMTQSPLSLPVTPGEPASISCRSSQSLLHGNGYNYLDWYLQKPGQSPHLLIYLGSNRASGVPDRLSGSGSGTDFTLKISRVEAEDVGVYYCMQALQTPLTFGGGTKVEIKR

SEQ ID NO: 2435 - DNA, 33 bp, Artificial Sequence
  synthetic
cagagcctcctgcatggtaatggatacaactat

SEQ ID NO: 2436 - protein, 11 aa, Artificial Sequence
  synthetic
QSLLHGNGYNY

SEQ ID NO: 2437 - DNA, 9 bp, Artificial Sequence
  synthetic
ttgggttct

SEQ ID NO: 2438 - protein, 3 aa, Artificial Sequence
  synthetic
LGS

SEQ ID NO: 2439 - DNA, 27 bp, Artificial Sequence
  synthetic
atgcaagctctacaaactcctctcact

SEQ ID NO: 2440 - protein, 9 aa, Artificial Sequence
  synthetic
MQALQTPLT

SEQ ID NO: 2441 - DNA, 384 bp, Artificial Sequence
  synthetic
gaggtgcagctggtggagtcgggcccaggactggtgaagccttcggagaccctgtccctcacctgcactgtctctggtggctccatcagtagtaactattggagctggatccggcagcccccagggaagggactggagtggattgggtatatctattccagtgggagcaccaactacaacccctccctcaggagtcgagtcaccatatcagtagacacgtccaagaaccagttctccctgaacctgagctctgtgaccgctgcggacacggccgtgtattactgtgcgagagatgggtttgattactatggttcggggagttcaaactacttctactacggtatggacgtctggggccaagggaccacggtcaccgtctcctca

SEQ ID NO: 2442 - protein, 128 aa, Artificial Sequence
  synthetic
EVQLVESGPGLVKPSETLSLTCTVSGGSISSNYWSWIRQPPGKGLEWIGYIYSSGSTNYNPSLRSRVTISVDTSKNQFSLNLSSVTAADTAVYYCARDGFDYYGSGSSNYFYYGMDVWGQGTTVTVSS

SEQ ID NO: 2443 - DNA, 24 bp, Artificial Sequence
  synthetic
ggtggctccatcagtagtaactat

SEQ ID NO: 2444 - protein, 8 aa, Artificial Sequence
  synthetic
GGSISSNY

SEQ ID NO: 2445 - DNA, 21 bp, Artificial Sequence
  synthetic
atctattccagtgggagcacc

SEQ ID NO: 2446 - protein, 7 aa, Artificial Sequence
  synthetic
IYSSGST

SEQ ID NO: 2447 - DNA, 66 bp, Artificial Sequence
  synthetic
gcgagagatgggtttgattactatggttcggggagttcaaactacttctactacggtatggacgtc

SEQ ID NO: 2448 - protein, 22 aa, Artificial Sequence
  synthetic
ARDGFDYYGSGSSNYFYYGMDV

SEQ ID NO: 2449 - DNA, 339 bp, Artificial Sequence
  synthetic
gacatcgtgatgacccagtctccactctccctgcccgtcacccctggagagccggccttcatctcctgcaggtctagtcagagcctcctgcgtagtaatggatacaactatttggattggctcctgcagaggccagggcagtctccacaactcctgatctatttgggttctaatcgggcctccggggtccctgacaggttcagtggcagtggatcaggcacagattttacactgaaaatcagcagagtggaggctgaggatgttgggatttattactgtatgcaaactctacagactccgtggacgttcggccaagggaccaaggtggagatcaaacga

SEQ ID NO: 2450 - protein, 113 aa, Artificial Sequence
  synthetic
DIVMTQSPLSLPVTPGEPAFISCRSSQSLLRSNGYNYLDWLLQRPGQSPQLLIYLGSNRASGVPDRFSGSGSGTDFTLKISRVEAEDVGIYYCMQTLQTPWTFGQGTKVEIKR

SEQ ID NO: 2451 - DNA, 33 bp, Artificial Sequence
  synthetic
cagagcctcctgcgtagtaatggatacaactat

SEQ ID NO: 2452 - protein, 11 aa, Artificial Sequence
  synthetic
QSLLRSNGYNY

SEQ ID NO: 2453 - DNA, 9 bp, Artificial Sequence
  synthetic
ttgggttct

SEQ ID NO: 2454 - protein, 3 aa, Artificial Sequence
  synthetic
LGS

SEQ ID NO: 2455 - DNA, 27 bp, Artificial Sequence
  synthetic
atgcaaactctacagactccgtggacg

SEQ ID NO: 2456 - protein, 9 aa, Artificial Sequence
  synthetic
MQTLQTPWT

SEQ ID NO: 2457 - DNA, 354 bp, Artificial Sequence
  synthetic
caggtgcagctggtggagtctgggggaggcttggtacagcctggggggtccctgagactctcctgtgcaacctctggattcacctttagcaactatgccatgatctgggtccgccaggctccagggaaggggctggagtgggtctcagctattagtggtactggtgttagcacatactacgcagactccgtgaagggccggttcaccatctccagagacaattccaacaacacgctgtttctgcaaatgaacagcctgagagccgaggacacggccgtatattactgtgcgaaaattggctacggtgacttctttgactactggggccagggaaccctggtcaccgtctcctca

SEQ ID NO: 2458 - protein, 118 aa, Artificial Sequence
  synthetic
QVQLVESGGGLVQPGGSLRLSCATSGFTFSNYAMIWVRQAPGKGLEWVSAISGTGVSTYYADSVKGRFTISRDNSNNTLFLQMNSLRAEDTAVYYCAKIGYGDFFDYWGQGTLVTVSS

SEQ ID NO: 2459 - DNA, 24 bp, Artificial Sequence
  synthetic
ggattcacctttagcaactatgcc

SEQ ID NO: 2460 - protein, 8 aa, Artificial Sequence
  synthetic
GFTFSNYA

SEQ ID NO: 2461 - DNA, 24 bp, Artificial Sequence
  synthetic
attagtggtactggtgttagcaca

SEQ ID NO: 2462 - protein, 8 aa, Artificial Sequence
  synthetic
ISGTGVST

SEQ ID NO: 2463 - DNA, 33 bp, Artificial Sequence
  synthetic
gcgaaaattggctacggtgacttctttgactac

SEQ ID NO: 2464 - protein, 11 aa, Artificial Sequence
  synthetic
AKIGYGDFFDY

SEQ ID NO: 2465 - DNA, 324 bp, Artificial Sequence
  synthetic
gacatccagatgacccagtctccatcctccctgtctacatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcccactttcggcggagggaccaaggtggagatcaaacga

SEQ ID NO: 2466 - protein, 108 aa, Artificial Sequence
  synthetic
DIQMTQSPSSLSTSVGDRVTITCRASQSISSYLNWYQQKPGKAPKLLIYAASSLQSGVPSRFSGSGSGTDFTLTISSLQPEDFATYYCQQSYSTPPTFGGGTKVEIKR

SEQ ID NO: 2467 - DNA, 18 bp, Artificial Sequence
  synthetic
cagagcattagcagctat

SEQ ID NO: 2468 - protein, 6 aa, Artificial Sequence
  synthetic
QSISSY

SEQ ID NO: 2469 - DNA, 9 bp, Artificial Sequence
  synthetic
gctgcatcc

SEQ ID NO: 2470 - protein, 3 aa, Artificial Sequence
  synthetic
AAS

SEQ ID NO: 2471 - DNA, 27 bp, Artificial Sequence
  synthetic
caacagagttacagtacccctcccact

SEQ ID NO: 2472 - protein, 9 aa, Artificial Sequence
  synthetic
QQSYSTPPT

SEQ ID NO: 2473 - DNA, 378 bp, Artificial Sequence
  synthetic
caggtgcagctggtggagtctggtcctacgctggtgaaacccacacagaacctcacgctgacctgcaccttctctgggttctcactcaccactagtggagtgggtgtgggctggatccgtcagcccccaggaaaggccctggagtggcttggaatcatttattggaatgatgataaacgctatagcccatctctaaagagcaggctcaccatcagcaaggacacctccaaaaaccaggtggtccttacactgaccaacatgggccctgtggacacagccacatattactgtgcacacagaagttatagcactaactggccctactactactacggtatggacgtttggggccaggggaccacggtcaccgtctcctca

SEQ ID NO: 2474 - protein, 126 aa, Artificial Sequence
  synthetic
QVQLVESGPTLVKPTQNLTLTCTFSGFSLTTSGVGVGWIRQPPGKALEWLGIIYWNDDKRYSPSLKSRLTISKDTSKNQVVLTLTNMGPVDTATYYCAHRSYSTNWPYYYYGMDVWGQGTTVTVSS

SEQ ID NO: 2475 - DNA, 30 bp, Artificial Sequence; identical to SEQ ID NO: 2267
  synthetic

SEQ ID NO: 2476 - protein, 10 aa, Artificial Sequence
  synthetic
GFSLTTSGVG

SEQ ID NO: 2477 - DNA, 21 bp, Artificial Sequence
  synthetic
atttattggaatgatgataaa

SEQ ID NO: 2478 - protein, 7 aa, Artificial Sequence
  synthetic
IYWNDDK

SEQ ID NO: 2479 - DNA, 54 bp, Artificial Sequence
  synthetic
gcacacagaagttatagcactaactggccctactactactacggtatggacgtt

SEQ ID NO: 2480 - protein, 18 aa, Artificial Sequence
  synthetic
AHRSYSTNWPYYYYGMDV

SEQ ID NO: 2481 - DNA, 324 bp, Artificial Sequence
  synthetic
gacatccagatgacccagtctccctcttccgtgtctgcatctgttggagacagagtcaccatcacttgtcgggcgagtcagggtattaggaactggttagcctggtatcagcagaaaccagggaaagcccctaggctcctgatctatgattcatccagtttgcaaagtggggtcccatcaaggttcagcggcagtggatttgggacagatttcactctcaccatcagcagcctgcagcctgaagattttgcaacttactattgtcaacaggctaacactttcccattcactttcggccctgggaccaaggtggagatcaaacga

SEQ ID NO: 2482 - protein, 108 aa, Artificial Sequence
  synthetic
DIQMTQSPSSVSASVGDRVTITCRASQGIRNWLAWYQQKPGKAPRLLIYDSSSLQSGVPSRFSGSGFGTDFTLTISSLQPEDFATYYCQQANTFPFTFGPGTKVEIKR

SEQ ID NO: 2483 - DNA, 18 bp, Artificial Sequence
  synthetic
cagggtattaggaactgg

SEQ ID NO: 2484 - protein, 6 aa, Artificial Sequence
  synthetic
QGIRNW

SEQ ID NO: 2485 - DNA, 9 bp, Artificial Sequence
  synthetic
gattcatcc

SEQ ID NO: 2486 - protein, 3 aa, Artificial Sequence
  synthetic
DSS

SEQ ID NO: 2487 - DNA, 27 bp, Artificial Sequence
  synthetic
caacaggctaacactttcccattcact

SEQ ID NO: 2488 - protein, 9 aa, Artificial Sequence
  synthetic
QQANTFPFT

SEQ ID NO: 2489 - DNA, 378 bp, Artificial Sequence
  synthetic
caggtgcagctggtggagtctggtcctacgctggtgaaacccacacagaacctcacgctgacctgcaccttctctgggttctcactcaccactagtggagtgggtgtgggctggatccgtcagcccccaggaaaggccctggagtggcttggaatcatttattggaatgatgataaacgctacagtccatctctaaagagcaggctcaccatcaacaaggacacctccaaaaaccagctggtccttacaatgaccaacatggaccctgtggacacagccacatattactgtgcacacagaagttatagcactaactggccctactactactacggtatggacgtttggggccaagggaccacggtcaccgtctcctca

SEQ ID NO: 2490 - protein, 126 aa, Artificial Sequence
  synthetic
QVQLVESGPTLVKPTQNLTLTCTFSGFSLTTSGVGVGWIRQPPGKALEWLGIIYWNDDKRYSPSLKSRLTINKDTSKNQLVLTMTNMDPVDTATYYCAHRSYSTNWPYYYYGMDVWGQGTTVTVSS

SEQ ID NO: 2491 - DNA, 30 bp, Artificial Sequence; identical to SEQ ID NO: 2267
  synthetic

SEQ ID NO: 2492 - protein, 10 aa, Artificial Sequence
  synthetic
GFSLTTSGVG

SEQ ID NO: 2493 - DNA, 21 bp, Artificial Sequence
  synthetic
atttattggaatgatgataaa

SEQ ID NO: 2494 - protein, 7 aa, Artificial Sequence
  synthetic
IYWNDDK

SEQ ID NO: 2495 - DNA, 54 bp, Artificial Sequence; identical to SEQ ID NO: 2479
  synthetic

SEQ ID NO: 2496 - protein, 18 aa, Artificial Sequence
  synthetic
AHRSYSTNWPYYYYGMDV

SEQ ID NO: 2497 - DNA, 324 bp, Artificial Sequence
  synthetic
gacatccagatgacccagtctccctcttccgtgtctgcatctgttggagacagagtcaccatcacttgtcgggcgagtcagggtattaggaactggttagcctggtatcagcagaaacctgggaaagcccctaggctcctgatctatgattcatccagtttgcaaagtggggtcccatcaaggttcagcggcagtggatttgggacagatttcactctcaccatcagcagcctgcagcctgaagattttgcaacttactattgtcaacaggctaacactttcccattcactttcggccctgggaccaaggtggagatcaaacga

SEQ ID NO: 2498 - protein, 108 aa, Artificial Sequence; identical to SEQ ID NO: 2482
  synthetic

SEQ ID NO: 2499 - DNA, 18 bp, Artificial Sequence
  synthetic
cagggtattaggaactgg

SEQ ID NO: 2500 - protein, 6 aa, Artificial Sequence
  synthetic
QGIRNW

SEQ ID NO: 2501 - DNA, 9 bp, Artificial Sequence
  synthetic
gattcatcc

SEQ ID NO: 2502 - protein, 3 aa, Artificial Sequence
  synthetic
DSS

SEQ ID NO: 2503 - DNA, 27 bp, Artificial Sequence
  synthetic
caacaggctaacactttcccattcact

SEQ ID NO: 2504 - protein, 9 aa, Artificial Sequence
  synthetic
QQANTFPFT

SEQ ID NO: 2505 - DNA, 366 bp, Artificial Sequence
  synthetic
gaggtgcagctggtggagtctgggggaggcttggtacagcctggggggtccctgagactctcctgtgcagcctctggattcagctttagcagctatgccatgagctgggtccgccaggctccagggaagggtctggaatgggtctcaggtattagtggcagtggtggtagcacattaaacgcagactccgtgaagggccggttcaccatctccagagacaattccaagaaaacgctgtatctgcaaatgagcagcctgagagccgaggacacggccgtatattactgtgcgaaagtctttgactatagctacttctactacggtatggacgtctggggccaagggaccacggtcaccgtctcctca

SEQ ID NO: 2506 - protein, 122 aa, Artificial Sequence
  synthetic
EVQLVESGGGLVQPGGSLRLSCAASGFSFSSYAMSWVRQAPGKGLEWVSGISGSGGSTLNADSVKGRFTISRDNSKKTLYLQMSSLRAEDTAVYYCAKVFDYSYFYYGMDVWGQGTTVTVSS

SEQ ID NO: 2507 - DNA, 24 bp, Artificial Sequence
  synthetic
ggattcagctttagcagctatgcc

SEQ ID NO: 2508 - protein, 8 aa, Artificial Sequence
  synthetic
GFSFSSYA

SEQ ID NO: 2509 - DNA, 24 bp, Artificial Sequence
  synthetic
attagtggcagtggtggtagcaca

SEQ ID NO: 2510 - protein, 8 aa, Artificial Sequence
  synthetic
ISGSGGST

SEQ ID NO: 2511 - DNA, 45 bp, Artificial Sequence
  synthetic
gcgaaagtctttgactatagctacttctactacggtatggacgtc

SEQ ID NO: 2512 - protein, 15 aa, Artificial Sequence
  synthetic
AKVFDYSYFYYGMDV

SEQ ID NO: 2513 - DNA, 339 bp, Artificial Sequence
  synthetic
gacatcgtgatgacccagtctccactctccctgcccgtcacccctggagagccggcctccatctcctgcaggtctagtcagagcctcctgcatagtagtggatacaactatttggattggtacctgcagaggccagggcagtctccacagctcctgatctatttgggttctaatcgggcctccggggtccctgacaggttcagtggcagtggatcaggcacagattttacactgaaaatcagcagagtggaggctgaggatgttggggtttattactgcttgcaagttctacaaactccgtacacttttggccaggggaccaaggtggagatcaaacga

SEQ ID NO: 2514 - protein, 113 aa, Artificial Sequence
  synthetic
DIVMTQSPLSLPVTPGEPASISCRSSQSLLHSSGYNYLDWYLQRPGQSPQLLIYLGSNRASGVPDRFSGSGSGTDFTLKISRVEAEDVGVYYCLQVLQTPYTFGQGTKVEIKR

SEQ ID NO: 2515 - DNA, 33 bp, Artificial Sequence
  synthetic
cagagcctcctgcatagtagtggatacaactat

SEQ ID NO: 2516 - protein, 11 aa, Artificial Sequence
  synthetic
QSLLHSSGYNY

SEQ ID NO: 2517 - DNA, 9 bp, Artificial Sequence
  synthetic
ttgggttct

SEQ ID NO: 2518 - protein, 3 aa, Artificial Sequence
  synthetic
LGS

SEQ ID NO: 2519 - DNA, 27 bp, Artificial Sequence
  synthetic
ttgcaagttctacaaactccgtacact

SEQ ID NO: 2520 - protein, 9 aa, Artificial Sequence
  synthetic
LQVLQTPYT

SEQ ID NO: 2521 - DNA, 384 bp, Artificial Sequence
  synthetic
caggtgcagctggtggagtcgggcccaggactggtgaagccttcggagaccctgtccctcacctgcactgtctctggtggctccatcagtaattactactggagctggatccggcagcacccagggaagggactggagtggattgggtatatctattacagtgggagcaccaactacaaaccctccctcaagagtcgagtcaccatatcagtagacacgtccaagaaccagttctccctgaaactgagttctgtgaccgctgcggacacggccgtgtattactgtgcgagagataccattgattactatggttcggggagttcaagctactactactacggtatggacatctggggccaagggaccacggtcaccgtctcctca

SEQ ID NO: 2522 - protein, 128 aa, Artificial Sequence; identical to SEQ ID NO: 2250
  synthetic

SEQ ID NO: 2523 - DNA, 24 bp, Artificial Sequence
  synthetic
ggtggctccatcagtaattactac

SEQ ID NO: 2524 - protein, 8 aa, Artificial Sequence
  synthetic
GGSISNYY

SEQ ID NO: 2525 - DNA, 21 bp, Artificial Sequence
  synthetic
atctattacagtgggagcacc

SEQ ID NO: 2526 - protein, 7 aa, Artificial Sequence
  synthetic
IYYSGST

SEQ ID NO: 2527 - DNA, 66 bp, Artificial Sequence; identical to SEQ ID NO: 2255
  synthetic

SEQ ID NO: 2528 - protein, 22 aa, Artificial Sequence
  synthetic
ARDTIDYYGSGSSSYYYYGMDI

SEQ ID NO: 2529 - DNA, 339 bp, Artificial Sequence
  synthetic
gacatcgtgatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcggagtggaggctgaggatgttggggtttattactgcatgcaatctctacaaagtccgtggacgttcggccaagggaccaaggtggagatcaaacga

SEQ ID NO: 2530 - protein, 113 aa, Artificial Sequence; identical to SEQ ID NO: 2258
  synthetic

SEQ ID NO: 2531 - DNA, 33 bp, Artificial Sequence; identical to SEQ ID NO: 2259
  synthetic

SEQ ID NO: 2532 - protein, 11 aa, Artificial Sequence
  synthetic
QSLLHSNGYNY

SEQ ID NO: 2533 - DNA, 9 bp, Artificial Sequence
  synthetic
ttgggttct

SEQ ID NO: 2534 - protein, 3 aa, Artificial Sequence
  synthetic
LGS

SEQ ID NO: 2535 - DNA, 27 bp, Artificial Sequence
  synthetic
atgcaatctctacaaagtccgtggacg

SEQ ID NO: 2536 - protein, 9 aa, Artificial Sequence
  synthetic
MQSLQSPWT

SEQ ID NO: 2537 - DNA, 366 bp, Artificial Sequence
  synthetic
gaggtgcagctggtggagtcgggcccaggactggtgaagccttcggagaccctgtccctcacctgcactgtctctgatggctccatcagtacttactactggagctggatccggcagcccccaggaaagggactggagtggattgggtatatctattacagtgggagaaccaactacaacccctccctcaagagtcgagtcaccatttcagttgacacgtccaagaaccagttctccctgaagctgacctctgtgaccgctgcggacacggccgtatattactgtgcgagaggtgggagcagccctaactattactacttcggtatggacgtctggggccaagggaccacggtcaccgtctcctca

SEQ ID NO: 2538 - protein, 122 aa, Artificial Sequence
  synthetic
EVQLVESGPGLVKPSETLSLTCTVSDGSISTYYWSWIRQPPGKGLEWIGYIYYSGRTNYNPSLKSRVTISVDTSKNQFSLKLTSVTAADTAVYYCARGGSSPNYYYFGMDVWGQGTTVTVSS

SEQ ID NO: 2539 - DNA, 24 bp, Artificial Sequence
  synthetic
gatggctccatcagtacttactac

SEQ ID NO: 2540 - protein, 8 aa, Artificial Sequence
  synthetic
DGSISTYY

SEQ ID NO: 2541 - DNA, 21 bp, Artificial Sequence
  synthetic
atctattacagtgggagaacc

SEQ ID NO: 2542 - protein, 7 aa, Artificial Sequence
  synthetic
IYYSGRT

SEQ ID NO: 2543 - DNA, 48 bp, Artificial Sequence
  synthetic
gcgagaggtgggagcagccctaactattactacttcggtatggacgtc

SEQ ID NO: 2544 - protein, 16 aa, Artificial Sequence
  synthetic
ARGGSSPNYYYFGMDV

SEQ ID NO: 2545 - DNA, 342 bp, Artificial Sequence
  synthetic
gacatcctgatgacccagtctccagactccctggctgtgtctctgggcgagagggccaccatcaactgcatgtccagccatactattttatacagctccaacaataagaagtacttagcttggtaccagcagaaaccaggacagcctcctaagctgctcatttactgggcatctacccgggaatccggggtccctgaccgattcagtggcagcgggtctgggacagatttcactctcaccatcaccagcctgcaggctgaagatgtggcagtttattactgtcaacaatactataatactccgtggacgttcggccaagggaccaaggtggagatcaaacga

SEQ ID NO: 2546 - protein, 114 aa, Artificial Sequence
  synthetic
DILMTQSPDSLAVSLGERATINCMSSHTILYSSNNKKYLAWYQQKPGQPPKLLIYWASTRESGVPDRFSGSGSGTDFTLTITSLQAEDVAVYYCQQYYNTPWTFGQGTKVEIKR

SEQ ID NO: 2547 - DNA, 36 bp, Artificial Sequence
  synthetic
catactattttatacagctccaacaataagaagtac

SEQ ID NO: 2548 - protein, 12 aa, Artificial Sequence
  synthetic
HTILYSSNNKKY

SEQ ID NO: 2549 - DNA, 9 bp, Artificial Sequence
  synthetic
tgggcatct

SEQ ID NO: 2550 - protein, 3 aa, Artificial Sequence
  synthetic
WAS

SEQ ID NO: 2551 - DNA, 27 bp, Artificial Sequence
  synthetic
caacaatactataatactccgtggacg

SEQ ID NO: 2552 - protein, 9 aa, Artificial Sequence
  synthetic
QQYYNTPWT

SEQ ID NO: 2553 - DNA, 363 bp, Artificial Sequence
  synthetic
gaggtgcagctggtggagtctggcccaggactggtgaagccttcggagaccctgtccctcacctgcactgtctctggtggctccatcagtagttactactggagctggatccggcagcccccagggaagggactggagtggattgggtatatctattacagtgggaacaccaactacaacccctccctcaagagtcgagtcaccatatctgtcgacacgtccaagaaccagttctccctgaagctgacctctgtgaccgctgcggacacggccgtgtattactgtgcgagagattcttattacgatttttggagtggttattataccctctggggccagggaaccacggtcaccgtctcctca

SEQ ID NO: 2554 - protein, 121 aa, Artificial Sequence
  synthetic
EVQLVESGPGLVKPSETLSLTCTVSGGSISSYYWSWIRQPPGKGLEWIGYIYYSGNTNYNPSLKSRVTISVDTSKNQFSLKLTSVTAADTAVYYCARDSYYDFWSGYYTLWGQGTTVTVSS

SEQ ID NO: 2555 - DNA, 24 bp, Artificial Sequence
  synthetic
ggtggctccatcagtagttactac

SEQ ID NO: 2556 - protein, 8 aa, Artificial Sequence
  synthetic
GGSISSYY

SEQ ID NO: 2557 - DNA, 21 bp, Artificial Sequence
  synthetic
atctattacagtgggaacacc

SEQ ID NO: 2558 - protein, 7 aa, Artificial Sequence
  synthetic
IYYSGNT

SEQ ID NO: 2559 - DNA, 45 bp, Artificial Sequence
  synthetic
gcgagagattcttattacgatttttggagtggttattataccctc

SEQ ID NO: 2560 - protein, 15 aa, Artificial Sequence
  synthetic
ARDSYYDFWSGYYTL

SEQ ID NO: 2561 - DNA, 342 bp, Artificial Sequence
  synthetic
gacatcgtgatgacccagtctccagactccctggctgtgtctctgggcgagtgggccaccatcaactgcaagtccagccagagtattttgttcagctccaacaataagaactacttagcttggtaccagcagaaaccaggacagcctcctaagttgctcatttactgggcatctacccgggaatccggggtccctgaccgcttcagtggcagcgggtctgggacagatttcactctcaccatcagcagcctgcaggctgaagatgtggcagtttattactgtcagcaatattataatactcctcggacgttcggccaagggaccaaggtggagatcaaacga

SEQ ID NO: 2562 - protein, 114 aa, Artificial Sequence
  synthetic
DIVMTQSPDSLAVSLGEWATINCKSSQSILFSSNNKNYLAWYQQKPGQPPKLLIYWASTRESGVPDRFSGSGSGTDFTLTISSLQAEDVAVYYCQQYYNTPRTFGQGTKVEIKR

SEQ ID NO: 2563 - DNA, 36 bp, Artificial Sequence
  synthetic
cagagtattttgttcagctccaacaataagaactac

SEQ ID NO: 2564 - protein, 12 aa, Artificial Sequence
  synthetic
QSILFSSNNKNY

SEQ ID NO: 2565 - DNA, 9 bp, Artificial Sequence
  synthetic
tgggcatct

SEQ ID NO: 2566 - protein, 3 aa, Artificial Sequence
  synthetic
WAS

SEQ ID NO: 2567 - DNA, 27 bp, Artificial Sequence
  synthetic
cagcaatattataatactcctcggacg

SEQ ID NO: 2568 - protein, 9 aa, Artificial Sequence
  synthetic
QQYYNTPRT

SEQ ID NO: 2569 - DNA, 357 bp, Artificial Sequence
  synthetic
gaggtgcagctggtggagtctgggggaggcgtggtccagtctgggaggtccctgagactctcctgtgcagcgtctggattcaccttcagtgactatggcatgcactgggtccggcaggctccaggcaaggggctggagtgggtggcagttatttggtatgatggaaataaaaaagactgtgtagactccgtgaagggccgattcaccatctccagagacaattccaagaacacgctgtatctagaaatgaatagcctgagagccgaggacacggccgtgtattactgtgcgagaatgaggtataactggaactcatttgactactggggccagggaaccctggtcaccgtctcctca

SEQ ID NO: 2570 - protein, 119 aa, Artificial Sequence
  synthetic
EVQLVESGGGVVQSGRSLRLSCAASGFTFSDYGMHWVRQAPGKGLEWVAVIWYDGNKKDCVDSVKGRFTISRDNSKNTLYLEMNSLRAEDTAVYYCARMRYNWNSFDYWGQGTLVTVSS

SEQ ID NO: 2571 - DNA, 24 bp, Artificial Sequence
  synthetic
ggattcaccttcagtgactatggc

SEQ ID NO: 2572 - protein, 8 aa, Artificial Sequence
  synthetic
GFTFSDYG

SEQ ID NO: 2573 - DNA, 24 bp, Artificial Sequence
  synthetic
atttggtatgatggaaataaaaaa

SEQ ID NO: 2574 - protein, 8 aa, Artificial Sequence
  synthetic
IWYDGNKK

SEQ ID NO: 2575 - DNA, 36 bp, Artificial Sequence
  synthetic
gcgagaatgaggtataactggaactcatttgactac

SEQ ID NO: 2576 - protein, 12 aa, Artificial Sequence
  synthetic
ARMRYNWNSFDY

SEQ ID NO: 2577 - DNA, 324 bp, Artificial Sequence
  synthetic
gacatccagatgacccagtctccatcttccctgtctgcatctgaaggagacagagtcaccatcacttgccaggcgagtcaggtcactcacaattacttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatatttctgtcaacagtatgttaatttccctctcactttcggcggagggaccaaggtggagatcaaacga

SEQ ID NO: 2578 - protein, 108 aa, Artificial Sequence
  synthetic
DIQMTQSPSSLSASEGDRVTITCQASQVTHNYLNWYQQKPGKAPKLLIYDASNLETGVPSRFSGSGSGTDFTFTISSLQPEDIATYFCQQYVNFPLTFGGGTKVEIKR

SEQ ID NO: 2579 - DNA, 18 bp, Artificial Sequence
  synthetic
caggtcactcacaattac

SEQ ID NO: 2580 - protein, 6 aa, Artificial Sequence
  synthetic
QVTHNY

SEQ ID NO: 2581 - DNA, 9 bp, Artificial Sequence
  synthetic
gatgcatcc

SEQ ID NO: 2582 - protein, 3 aa, Artificial Sequence
  synthetic
DAS

SEQ ID NO: 2583 - DNA, 27 bp, Artificial Sequence
  synthetic
caacagtatgttaatttccctctcact

SEQ ID NO: 2584 - protein, 9 aa, Artificial Sequence
  synthetic
QQYVNFPLT

SEQ ID NO: 2585 - DNA, 351 bp, Artificial Sequence
  synthetic
gaggtgcagctggtggagtctggagctgaaatgaagaagcctggggcctcagtgaaggtctcctgtaaggcctctggtcacaccttcatcagttatggtatcagctgggtgcgacaggcccctggacaagggcttgagtggatgggatggaccagcccttacaatggtaacacaaactatgcacagaagttccagggcagagtcaccatgaccacagacacatccacgaatacaacctacatggaaatgaggagcctgagatctgacgacacggccgtatattactgtacgagaggctggttcgatgcttttgatatctggggtcaagggacaatggtcaccgtctcctca

SEQ ID NO: 2586 - protein, 117 aa, Artificial Sequence
  synthetic
EVQLVESGAEMKKPGASVKVSCKASGHTFISYGISWVRQAPGQGLEWMGWTSPYNGNTNYAQKFQGRVTMTTDTSTNTTYMEMRSLRSDDTAVYYCTRGWFDAFDIWGQGTMVTVSS

SEQ ID NO: 2587 - DNA, 24 bp, Artificial Sequence
  synthetic
ggtcacaccttcatcagttatggt

SEQ ID NO: 2588 - protein, 8 aa, Artificial Sequence
  synthetic
GHTFISYG

SEQ ID NO: 2589 - DNA, 24 bp, Artificial Sequence
  synthetic
accagcccttacaatggtaacaca

SEQ ID NO: 2590 - protein, 8 aa, Artificial Sequence
  synthetic
TSPYNGNT

SEQ ID NO: 2591 - DNA, 30 bp, Artificial Sequence
  synthetic
acgagaggctggttcgatgcttttgatatc

SEQ ID NO: 2592 - protein, 10 aa, Artificial Sequence
  synthetic
TRGWFDAFDI

SEQ ID NO: 2593 - DNA, 324 bp, Artificial Sequence
  synthetic
gacatccagatgacccagtctccatcctccctgtctgcatctgtaggagacagagtcaccatctcttgccggtcacgtcagagcattagcagctatttaaattggtatcagcagaaaccagggaaagcccctaagctcctgatctatgctgcatccagtttgcaaagtggggtcccatcaaggttcagtggcagtgtatctggggcagatttcactctcaccatcagcagtctgcaacctgaagattttgcaactttctactgtcaacagagttacactacccctccgacgttcggccaagggaccaaggtggaaatcaaacga

SEQ ID NO: 2594 - protein, 108 aa, Artificial Sequence
  synthetic
DIQMTQSPSSLSASVGDRVTISCRSRQSISSYLNWYQQKPGKAPKLLIYAASSLQSGVPSRFSGSVSGADFTLTISSLQPEDFATFYCQQSYTTPPTFGQGTKVEIKR

SEQ ID NO: 2595 - DNA, 18 bp, Artificial Sequence
  synthetic
cagagcattagcagctat

SEQ ID NO: 2596 - protein, 6 aa, Artificial Sequence
  synthetic
QSISSY

SEQ ID NO: 2597 - DNA, 9 bp, Artificial Sequence
  synthetic
gctgcatcc

SEQ ID NO: 2598 - protein, 3 aa, Artificial Sequence
  synthetic
AAS

SEQ ID NO: 2599 - DNA, 27 bp, Artificial Sequence
  synthetic
caacagagttacactacccctccgacg

SEQ ID NO: 2600 - protein, 9 aa, Artificial Sequence
  synthetic
QQSYTTPPT

SEQ ID NO: 2601 - DNA, 366 bp, Artificial Sequence
  synthetic
gaggtgcagctggtggagtctggagcagaggtgaaaaagcccggggagtctctgaagatctcctgtaagggttctggatacacctttaccaactactggatcggctgggtgcgccagatgcccgggaaaggcctggagtggatggggatcatctatccaggtgactctgagaccagatacagtccgtccttccaaggccaggtcaccatctcagccgacaagtccatcagcaccgcctacctgcagtggagcagcctgaaggcctcggacaccgccttattttactgtgcgagacttgggaggttcttcgacaactactacgctatggacgtctggggccaagggaccacggtcaccgtctcctca

SEQ ID NO: 2602 - protein, 122 aa, Artificial Sequence
  synthetic
EVQLVESGAEVKKPGESLKISCKGSGYTFTNYWIGWVRQMPGKGLEWMGIIYPGDSETRYSPSFQGQVTISADKSISTAYLQWSSLKASDTALFYCARLGRFFDNYYAMDVWGQGTTVTVSS

SEQ ID NO: 2603 - DNA, 24 bp, Artificial Sequence
  synthetic
ggatacacctttaccaactactgg

SEQ ID NO: 2604 - protein, 8 aa, Artificial Sequence
  synthetic
GYTFTNYW

SEQ ID NO: 2605 - DNA, 24 bp, Artificial Sequence
  synthetic
atctatccaggtgactctgagacc

SEQ ID NO: 2606 - protein, 8 aa, Artificial Sequence
  synthetic
IYPGDSET

SEQ ID NO: 2607 - DNA, 45 bp, Artificial Sequence
  synthetic
gcgagacttgggaggttcttcgacaactactacgctatggacgtc

SEQ ID NO: 2608 - protein, 15 aa, Artificial Sequence
  synthetic
ARLGRFFDNYYAMDV

SEQ ID NO: 2609 - DNA, 324 bp, Artificial Sequence
  synthetic
gacatccagatgacccagtctccatcctccctgtctgcatctgtaggagacagagtcattatcacttgtcgggcaagtcagagcattagcacctatttaaattggtatcagcagaaaccagggaaagcccctaagctcctgatctatggtgcgtccagtttgcaaagtggggtcccatcaaggttcagtggcagtggatctgggacagatttcactctcaccatcagcagtctgcaatttgcagattttgaaaattactactgtcaacagacttacagtatcccgtacacttttggccaggggaccaaggtggagatcaaacga

SEQ ID NO: 2610 - protein, 108 aa, Artificial Sequence
  synthetic
DIQMTQSPSSLSASVGDRVIITCRASQSISTYLNWYQQKPGKAPKLLIYGASSLQSGVPSRFSGSGSGTDFTLTISSLQFADFENYYCQQTYSIPYTFGQGTKVEIKR

SEQ ID NO: 2611 - DNA, 18 bp, Artificial Sequence
  synthetic
cagagcattagcacctat

SEQ ID NO: 2612 - protein, 6 aa, Artificial Sequence
  synthetic
QSISTY

SEQ ID NO: 2613 - DNA, 9 bp, Artificial Sequence
  synthetic
ggtgcgtcc

SEQ ID NO: 2614 - protein, 3 aa, Artificial Sequence
  synthetic
GAS

SEQ ID NO: 2615 - DNA, 27 bp, Artificial Sequence
  synthetic
caacagacttacagtatcccgtacact

SEQ ID NO: 2616 - protein, 9 aa, Artificial Sequence
  synthetic
QQTYSIPYT

SEQ ID NO: 2617 - DNA, 357 bp, Artificial Sequence
  synthetic
caggtgcagctggtggagtctgggggaggcgtggtccagcctgggaagtccctgagactctcctgtgcagcgtctggattcaccttcagtgactatggaatgcactgggtccggcaggctccaggcaagggactggagtgggtggcagttatttggtatgatgggaataaaaaagactgtgtagactccgtgaagggccgattcaccatctccagagacaattccaagaacacactgtatcttcaaatgaatagcctgagagccgaggacacggctgtgtattactgtgcgagaatgaggtataactggaactcgtttgactgctggggccagggaaccctggtcaccgtctcctca

SEQ ID NO: 2618 - protein, 119 aa, Artificial Sequence
  synthetic
QVQLVESGGGVVQPGKSLRLSCAASGFTFSDYGMHWVRQAPGKGLEWVAVIWYDGNKKDCVDSVKGRFTISRDNSKNTLYLQMNSLRAEDTAVYYCARMRYNWNSFDCWGQGTLVTVSS

SEQ ID NO: 2619 - DNA, 24 bp, Artificial Sequence
  synthetic
ggattcaccttcagtgactatgga

SEQ ID NO: 2620 - protein, 8 aa, Artificial Sequence
  synthetic
GFTFSDYG

SEQ ID NO: 2621 - DNA, 24 bp, Artificial Sequence
  synthetic
atttggtatgatgggaataaaaaa

SEQ ID NO: 2622 - protein, 8 aa, Artificial Sequence
  synthetic
IWYDGNKK

SEQ ID NO: 2623 - DNA, 36 bp, Artificial Sequence
  synthetic
gcgagaatgaggtataactggaactcgtttgactgc

SEQ ID NO: 2624 - protein, 12 aa, Artificial Sequence
  synthetic
ARMRYNWNSFDC

SEQ ID NO: 2625 - DNA, 324 bp, Artificial Sequence
  synthetic
gacatccagatgacccagtctccatcctccctgtatgcatctgtaggagacagagtcaccatcacttgccaggcgagtcaggactctcacaactatttaaattggtatcagcagaaaccagggaaagcccctaagctcctgatctacgatgcatccaatttggaaacaggagtcccatcaaggttcagtggaagtggttctgggacagattttactttcaccatcagcagcctgcagcctgaagatattgcaacatatttctgtcaacagtatgttaatttccctctcactttcggcggagggaccaaggtggagatcaaacga

SEQ ID NO: 2626 - protein, 108 aa, Artificial Sequence
  synthetic
DIQMTQSPSSLYASVGDRVTITCQASQDSHNYLNWYQQKPGKAPKLLIYDASNLETGVPSRFSGSGSGTDFTFTISSLQPEDIATYFCQQYVNFPLTFGGGTKVEIKR

SEQ ID NO: 2627 - DNA, 18 bp, Artificial Sequence
  synthetic
caggactctcacaactat

SEQ ID NO: 2628 - protein, 6 aa, Artificial Sequence
  synthetic
QDSHNY

SEQ ID NO: 2629 - DNA, 9 bp, Artificial Sequence
  synthetic
gatgcatcc

SEQ ID NO: 2630 - protein, 3 aa, Artificial Sequence
  synthetic
DAS

SEQ ID NO: 2631 - DNA, 27 bp, Artificial Sequence
  synthetic
caacagtatgttaatttccctctcact

SEQ ID NO: 2632 - protein, 9 aa, Artificial Sequence
  synthetic
QQYVNFPLT

SEQ ID NO: 2633 - DNA, 366 bp, Artificial Sequence
  synthetic
caggtgcagctggtggagtctggagcagaggtgaaaaagcccggggagtctctgaagatctcctgtaagggttctggatacacctttaccaactactggatcggctgggtgcgccagatgcccgggaaaggcctggagtggatggggatcatctatccaggtgactctgagaccagatacagtccgtccttccaaggccaggtcaccatctcagccgacaagtccatcagcaccgcctacctgcagtggagcagcctgaaggcctcggacaccgccttattttactgtgcgagacttgggaggttcttcgacaactactacgctatggacgtctggggccaagggaccacggtcaccgtctcctca

SEQ ID NO: 2634 - protein, 122 aa, Artificial Sequence
  synthetic
QVQLVESGAEVKKPGESLKISCKGSGYTFTNYWIGWVRQMPGKGLEWMGIIYPGDSETRYSPSFQGQVTISADKSISTAYLQWSSLKASDTALFYCARLGRFFDNYYAMDVWGQGTTVTVSS

SEQ ID NO: 2635 - DNA, 24 bp, Artificial Sequence
  synthetic
ggatacacctttaccaactactgg

SEQ ID NO: 2636 - protein, 8 aa, Artificial Sequence
  synthetic
GYTFTNYW

SEQ ID NO: 2637 - DNA, 24 bp, Artificial Sequence
  synthetic
atctatccaggtgactctgagacc

SEQ ID NO: 2638 - protein, 8 aa, Artificial Sequence
  synthetic
IYPGDSET

SEQ ID NO: 2639 - DNA, 45 bp, Artificial Sequence; identical to SEQ ID NO: 2607
  synthetic

SEQ ID NO: 2640 - protein, 15 aa, Artificial Sequence
  synthetic
ARLGRFFDNYYAMDV

SEQ ID NO: 2641 - DNA, 324 bp, Artificial Sequence
  synthetic
gacatcctgatgacccagtctccatcctcactgtctgcatctgtaggagacagagtcaccatcacttgtcgggcgagtcagggcattaccaattatttagcctggtttcagcagaaaccagggaaagcccctaagctcctgatctatggtgcgtccagtttgcaaagtggggtcccatcaaggttcagtggcagtggatctgggacagatttcactctcaccatcagcagtctgcaatttgcagattttgaaaattactactgtcaacagacttacagtatcccgtacacttttggccaggggaccaaggtggaaatcaaacga

SEQ ID NO: 2642 - protein, 108 aa, Artificial Sequence
  synthetic
DILMTQSPSSLSASVGDRVTITCRASQGITNYLAWFQQKPGKAPKLLIYGASSLQSGVPSRFSGSGSGTDFTLTISSLQFADFENYYCQQTYSIPYTFGQGTKVEIKR

SEQ ID NO: 2643 - DNA, 18 bp, Artificial Sequence
  synthetic
cagggcattaccaattat

SEQ ID NO: 2644 - protein, 6 aa, Artificial Sequence
  synthetic
QGITNY

SEQ ID NO: 2645 - DNA, 9 bp, Artificial Sequence
  synthetic
ggtgcgtcc

SEQ ID NO: 2646 - protein, 3 aa, Artificial Sequence
  synthetic
GAS

SEQ ID NO: 2647 - DNA, 27 bp, Artificial Sequence
  synthetic
caacagacttacagtatcccgtacact

SEQ ID NO: 2648 - protein, 9 aa, Artificial Sequence
  synthetic
QQTYSIPYT

SEQ ID NO: 2649 - DNA, 348 bp, Artificial Sequence
  synthetic
caggtgcagctggtggagtcgggcccaggactggtgaagccttcggagaccctgtccctcacctgcactgtctctggtggctccatcagtagttactactggagctggatccggcagcccccagggaagggactggagtggattggatatatctattacagtgggagcaccaagtacaacccctccctcaagagtcgagtcaccatatcagtagacacgtccaaaaaccagttctccctgaaactgaactctgtgaccgctgcggacacggccatgtattactgtgcgagagataacggtgacctctttgactactggggccagggaaccctggtcaccgtctcctca

SEQ ID NO: 2650 - protein, 116 aa, Artificial Sequence
  synthetic
QVQLVESGPGLVKPSETLSLTCTVSGGSISSYYWSWIRQPPGKGLEWIGYIYYSGSTKYNPSLKSRVTISVDTSKNQFSLKLNSVTAADTAMYYCARDNGDLFDYWGQGTLVTVSS

SEQ ID NO: 2651 - DNA, 24 bp, Artificial Sequence
  synthetic
ggtggctccatcagtagttactac

SEQ ID NO: 2652 - protein, 8 aa, Artificial Sequence
  synthetic
GGSISSYY

SEQ ID NO: 2653 - DNA, 21 bp, Artificial Sequence
  synthetic
atctattacagtgggagcacc

SEQ ID NO: 2654 - protein, 7 aa, Artificial Sequence
  synthetic
IYYSGST

SEQ ID NO: 2655 - DNA, 30 bp, Artificial Sequence
  synthetic
gcgagagataacggtgacctctttgactac

SEQ ID NO: 2656 - protein, 10 aa, Artificial Sequence
  synthetic
ARDNGDLFDY

SEQ ID NO: 2657 - DNA, 324 bp, Artificial Sequence
  synthetic
gacatcgtgatgacccagtctccatcctccctgtctgcatctgtaggagacagagtcaccagcacttgccgggcaagtcagagcattagtagctatttaaattggtatcagcagaaaccagggaaagcccctaagctcctgatctatgctacatccagtttgaaaagtggggtcccatcaaggttcagtggcagtggatctgggacagatttcactctcaccatcagcagtctgcaacctgaagattttgcaacttactactgtcaacagagttacagtatcccgtacacttttggccaggggaccaaggtggagatcaaacga

SEQ ID NO: 2658 - protein, 108 aa, Artificial Sequence
  synthetic
DIVMTQSPSSLSASVGDRVTSTCRASQSISSYLNWYQQKPGKAPKLLIYATSSLKSGVPSRFSGSGSGTDFTLTISSLQPEDFATYYCQQSYSIPYTFGQGTKVEIKR

SEQ ID NO: 2659 - DNA, 18 bp, Artificial Sequence
  synthetic
cagagcattagtagctat

SEQ ID NO: 2660 - protein, 6 aa, Artificial Sequence
  synthetic
QSISSY

SEQ ID NO: 2661 - DNA, 9 bp, Artificial Sequence
  synthetic
gctacatcc

SEQ ID NO: 2662 - protein, 3 aa, Artificial Sequence
  synthetic
ATS

SEQ ID NO: 2663 - DNA, 27 bp, Artificial Sequence
  synthetic
caacagagttacagtatcccgtacact

SEQ ID NO: 2664 - protein, 9 aa, Artificial Sequence
  synthetic
QQSYSIPYT

SEQ ID NO: 2665 - DNA, 369 bp, Artificial Sequence
  synthetic
caggtgcagctggtggagtctgggggaggcttggtacagcctggcaggtccctgagactctcctgtgcagcctctggattcacctttgatgatcatggcatgcactgggtccggcaagctccagggaagggcctggagtgggtctcaggtattagttggaatagtggtaacataggctatgcggactctgtgaagggccgattcaccatctccagagacaacgccaagaagtccctgtatctgcaaatgaacagtctgagagctgaggacacggccttgtattactgtgcaaaagatatagcagcagctggtctgttttactacggtatggacgtctggggccaagggaccacggtcaccgtctcctca

SEQ ID NO: 2666 - protein, 123 aa, Artificial Sequence
  synthetic
QVQLVESGGGLVQPGRSLRLSCAASGFTFDDHGMHWVRQAPGKGLEWVSGISWNSGNIGYADSVKGRFTISRDNAKKSLYLQMNSLRAEDTALYYCAKDIAAAGLFYYGMDVWGQGTTVTVSS

SEQ ID NO: 2667 - DNA, 24 bp, Artificial Sequence
  synthetic
ggattcacctttgatgatcatggc

SEQ ID NO: 2668 - protein, 8 aa, Artificial Sequence
  synthetic
GFTFDDHG

SEQ ID NO: 2669 - DNA, 24 bp, Artificial Sequence
  synthetic
attagttggaatagtggtaacata

SEQ ID NO: 2670 - protein, 8 aa, Artificial Sequence
  synthetic
ISWNSGNI

SEQ ID NO: 2671 - DNA, 48 bp, Artificial Sequence
  synthetic
gcaaaagatatagcagcagctggtctgttttactacggtatggacgtc

SEQ ID NO: 2672 - protein, 16 aa, Artificial Sequence
  synthetic
AKDIAAAGLFYYGMDV

SEQ ID NO: 2673 - DNA, 324 bp, Artificial Sequence
  synthetic
gacatccagatgacccagtctccatccttcctgtctgcatctgtcggagacagagtcaccatcacttgctgggccagtcagggcattagcacttatttagcctggtatcagaaaaacccagggaaagcccctaagctcctattctatgctgcctccactttcctaactggggtcccatcaaggttcagcggcagtggatctgggacagaattcactctcacaatcagcagcctgcagcctgaagattttgcaacttattactgtcaacagcttgatagttacccgctcactttcggcggagggaccaaggtggagatcaaacga

SEQ ID NO: 2674 - protein, 108 aa, Artificial Sequence
  synthetic
DIQMTQSPSFLSASVGDRVTITCWASQGISTYLAWYQKNPGKAPKLLFYAASTFLTGVPSRFSGSGSGTEFTLTISSLQPEDFATYYCQQLDSYPLTFGGGTKVEIKR

SEQ ID NO: 2675 - DNA, 18 bp, Artificial Sequence
  synthetic
cagggcattagcacttat

SEQ ID NO: 2676 - protein, 6 aa, Artificial Sequence
  synthetic
QGISTY

SEQ ID NO: 2677 - DNA, 9 bp, Artificial Sequence
  synthetic
gctgcctcc

SEQ ID NO: 2678 - protein, 3 aa, Artificial Sequence
  synthetic
AAS

SEQ ID NO: 2679 - DNA, 27 bp, Artificial Sequence
  synthetic
caacagcttgatagttacccgctcact

SEQ ID NO: 2680 - protein, 9 aa, Artificial Sequence
  synthetic
QQLDSYPLT

SEQ ID NO: 2681 - DNA, 375 bp, Artificial Sequence
  synthetic
gaggtgcagctggtggagtcgggcccaggactggtgaagccttcggagaccctgtccctcacctgcactgtctctggtggctccatcagtagttactattggagctggatccggcagcccccagggaagggactggagtggattgggtatatctattacagtgggagcaccaagtacaacccctccctcaagagtcgagtcaccatatcagtagacacgtccaagaaccagttctccctgaagctgagctctgtgaccactgcggacacggccgcgtattactgtgcgagagatccccagtattatcatgatagtagtggttattacgggggttttgactactggggccagggaaccccggtcaccgtctcctca

SEQ ID NO: 2682 - protein, 125 aa, Artificial Sequence
  synthetic
EVQLVESGPGLVKPSETLSLTCTVSGGSISSYYWSWIRQPPGKGLEWIGYIYYSGSTKYNPSLKSRVTISVDTSKNQFSLKLSSVTTADTAAYYCARDPQYYHDSSGYYGGFDYWGQGTPVTVSS

SEQ ID NO: 2683 - DNA, 24 bp, Artificial Sequence
  synthetic
ggtggctccatcagtagttactat

SEQ ID NO: 2684 - protein, 8 aa, Artificial Sequence
  synthetic
GGSISSYY

SEQ ID NO: 2685 - DNA, 21 bp, Artificial Sequence
  synthetic
atctattacagtgggagcacc

SEQ ID NO: 2686 - protein, 7 aa, Artificial Sequence
  synthetic
IYYSGST

SEQ ID NO: 2687 - DNA, 57 bp, Artificial Sequence
  synthetic
gcgagagatccccagtattatcatgatagtagtggttattacgggggttttgactac

SEQ ID NO: 2688 - protein, 19 aa, Artificial Sequence
  synthetic
ARDPQYYHDSSGYYGGFDY

SEQ ID NO: 2689 - DNA, 342 bp, Artificial Sequence
  synthetic
gacatcctgatgacccagtctccagactccctggctgtgtctctgggcgagcgggccaccatcaactgcaagtccagccagagtgttttatacaactccaacaataagaactacttagcttggtaccagcagaaaccaggacagacgcctaaactgctcatttactgggcatctacccgggaatccggggtccctgaccgattcagtggcagcgggtctgggacagatttcactctcaccatcagcagcctgcaggctgaagatgtggcagtttattactgtcagcaatattataatactccgtacacttttggccaggggaccaaggtggagatcaaacga

SEQ ID NO: 2690 - protein, 114 aa, Artificial Sequence
  synthetic
DILMTQSPDSLAVSLGERATINCKSSQSVLYNSNNKNYLAWYQQKPGQTPKLLIYWASTRESGVPDRFSGSGSGTDFTLTISSLQAEDVAVYYCQQYYNTPYTFGQGTKVEIKR

SEQ ID NO: 2691 - DNA, 36 bp, Artificial Sequence
  synthetic
cagagtgttttatacaactccaacaataagaactac

SEQ ID NO: 2692 - protein, 12 aa, Artificial Sequence
  synthetic
QSVLYNSNNKNY

SEQ ID NO: 2693 - DNA, 9 bp, Artificial Sequence
  synthetic
tgggcatct

SEQ ID NO: 2694 - protein, 3 aa, Artificial Sequence
  synthetic
WAS

SEQ ID NO: 2695 - DNA, 27 bp, Artificial Sequence
  synthetic
cagcaatattataatactccgtacact

SEQ ID NO: 2696 - protein, 9 aa, Artificial Sequence
  synthetic
QQYYNTPYT

SEQ ID NO: 2697 - DNA, 369 bp, Artificial Sequence
  synthetic
gaggtgcagctggtggagtctgggggaggcttggtacagcctggcaggtccctgagactctcctgtgcagcctctggattcacctttgatgattgtgccatgcactgggtccggctagctccagggaagggcctggagtgtgtctcaggtattagttggaatagtggtaacataggctatgcggactctgtgaagggccgattcaccatctccagagacaacgccaagaactccctgtatctgcaaatgaacagtctgagagctgaggacacggccttgtattactgtgcaaaagatatagcagcagctggtctgtattactacggtttggacgtctggggccgagggaccacggtcaccgtctcctca

SEQ ID NO: 2698 - protein, 123 aa, Artificial Sequence
  synthetic
EVQLVESGGGLVQPGRSLRLSCAASGFTFDDCAMHWVRLAPGKGLECVSGISWNSGNIGYADSVKGRFTISRDNAKNSLYLQMNSLRAEDTALYYCAKDIAAAGLYYYGLDVWGRGTTVTVSS

SEQ ID NO: 2699 - DNA, 24 bp, Artificial Sequence
  synthetic
ggattcacctttgatgattgtgcc

SEQ ID NO: 2700 - protein, 8 aa, Artificial Sequence
  synthetic
GFTFDDCA

SEQ ID NO: 2701 - DNA, 24 bp, Artificial Sequence
  synthetic
attagttggaatagtggtaacata

SEQ ID NO: 2702 - protein, 8 aa, Artificial Sequence
  synthetic
ISWNSGNI

SEQ ID NO: 2703 - DNA, 48 bp, Artificial Sequence
  synthetic
gcaaaagatatagcagcagctggtctgtattactacggtttggacgtc

SEQ ID NO: 2704 - protein, 16 aa, Artificial Sequence
  synthetic
AKDIAAAGLYYYGLDV

SEQ ID NO: 2705 - DNA, 324 bp, Artificial Sequence
  synthetic
gacatccagatgacccagtctccatccttcctgtctgcatctgtaggagacagagtcaccatcacttgctggtccagtcaggacattaacagttatttagtctggtatcagcaaaagccagggaaagcccctaaactcctgatctatgctgcatccactttgctcagtggggtcccatcaaggttcagcggcagtggatctgggacagagttcactctcacaatcagcagcctgcagcctgaagattttgcaacttattactgtcaacaccttaatggttacccgctcactttcggcggagggaccaaggtggagatcaaacga

SEQ ID NO: 2706 - protein, 108 aa, Artificial Sequence
  synthetic
DIQMTQSPSFLSASVGDRVTITCWSSQDINSYLVWYQQKPGKAPKLLIYAASTLLSGVPSRFSGSGSGTEFTLTISSLQPEDFATYYCQHLNGYPLTFGGGTKVEIKR

SEQ ID NO: 2707 - DNA, 18 bp, Artificial Sequence
  synthetic
caggacattaacagttat

SEQ ID NO: 2708 - protein, 6 aa, Artificial Sequence
  synthetic
QDINSY

SEQ ID NO: 2709 - DNA, 9 bp, Artificial Sequence
  synthetic
gctgcatcc

SEQ ID NO: 2710 - protein, 3 aa, Artificial Sequence
  synthetic
AAS

SEQ ID NO: 2711 - DNA, 27 bp, Artificial Sequence
  synthetic
caacaccttaatggttacccgctcact

SEQ ID NO: 2712 - protein, 9 aa, Artificial Sequence
  synthetic
QHLNGYPLT

SEQ ID NO: 2713 - DNA, 375 bp, Artificial Sequence
  synthetic
gaggtgcagctggtggagtcgggcccaggactggtgaagccttcggagaccctgtccctcacctgcactgtctctggtggctccatcagtagttattattggagttggatccggcagcccccagggaagggactggaatggattggatatatctattacagtgggaggaccaactacaacccctccgtcaagagtcgagtcaccatatcagtagacacgtccaaaaaccagttctccctgaagctgaactctgtgaccgctgcggacacggccgtgtattactgtgcgagagatccccagtattactctgagagaagtggttattacgggggttttgactactggggccagggagcactggtcaccgtctcctca

SEQ ID NO: 2714 - protein, 125 aa, Artificial Sequence
  synthetic
EVQLVESGPGLVKPSETLSLTCTVSGGSISSYYWSWIRQPPGKGLEWIGYIYYSGRTNYNPSVKSRVTISVDTSKNQFSLKLNSVTAADTAVYYCARDPQYYSERSGYYGGFDYWGQGALVTVSS

SEQ ID NO: 2715 - DNA, 24 bp, Artificial Sequence
  synthetic
ggtggctccatcagtagttattat

SEQ ID NO: 2716 - protein, 8 aa, Artificial Sequence
  synthetic
GGSISSYY

SEQ ID NO: 2717 - DNA, 21 bp, Artificial Sequence
  synthetic
atctattacagtgggaggacc

SEQ ID NO: 2718 - protein, 7 aa, Artificial Sequence
  synthetic
IYYSGRT

SEQ ID NO: 2719 - DNA, 57 bp, Artificial Sequence
  synthetic
gcgagagatccccagtattactctgagagaagtggttattacgggggttttgactac

SEQ ID NO: 2720 - protein, 19 aa, Artificial Sequence
  synthetic
ARDPQYYSERSGYYGGFDY

SEQ ID NO: 2721 - DNA, 342 bp, Artificial Sequence
  synthetic
gacatcctgatgacccagtctccagactccctggctgtgtctctgggcgagagggccaccatcaactgcaggtccagccagagtgttttgttcagctccaacaattggaactatttagcttggtaccagcagaagccaggacagcctcctaagttgctcatttactgggcatctatccgggaatccggggtccctgaccgattcagtggcagcgggtctgggacagatttcactctcaccatcagcagcctgcaggctgaagatgtggcagtttattactgtcagcaatattataatactccgtacacttttggccaggggaccaaggtggagatcaaacga

SEQ ID NO: 2722 - protein, 114 aa, Artificial Sequence
  synthetic
DILMTQSPDSLAVSLGERATINCRSSQSVLFSSNNWNYLAWYQQKPGQPPKLLIYWASIRESGVPDRFSGSGSGTDFTLTISSLQAEDVAVYYCQQYYNTPYTFGQGTKVEIKR

SEQ ID NO: 2723 - DNA, 36 bp, Artificial Sequence
  synthetic
cagagtgttttgttcagctccaacaattggaactat

SEQ ID NO: 2724 - protein, 12 aa, Artificial Sequence
  synthetic
QSVLFSSNNWNY

SEQ ID NO: 2725 - DNA, 9 bp, Artificial Sequence
  synthetic
tgggcatct

SEQ ID NO: 2726 - protein, 3 aa, Artificial Sequence
  synthetic
WAS

SEQ ID NO: 2727 - DNA, 27 bp, Artificial Sequence
  synthetic
cagcaatattataatactccgtacact

SEQ ID NO: 2728 - protein, 9 aa, Artificial Sequence
  synthetic
QQYYNTPYT

SEQ ID NO: 2729 - DNA, 375 bp, Artificial Sequence
  synthetic
gaggtgcagctggtggagtcgggcccaggactggtgaagccttcggagaccctgtccctcacctgcactgtctctggtggctccatcagtagttactactggagctggatccggcagcccccagagaagggactggagtggattgggtatatctattacagtgggagcaccaactacaacccctccctcaagagtcgagtcaccatatcagtagacacgtccaagaaccagttctccctgaaactgagctctgtgaccgctgcggacacggccgtttattactgtgcgagagatacccagtattactttgatagtagtggttattacgggggttttgactactggggccagggaaccctggtcaccgtctcctca

SEQ ID NO: 2730 - protein, 125 aa, Artificial Sequence
  synthetic
EVQLVESGPGLVKPSETLSLTCTVSGGSISSYYWSWIRQPPEKGLEWIGYIYYSGSTNYNPSLKSRVTISVDTSKNQFSLKLSSVTAADTAVYYCARDTQYYFDSSGYYGGFDYWGQGTLVTVSS

SEQ ID NO: 2731 - DNA, 24 bp, Artificial Sequence
  synthetic
ggtggctccatcagtagttactac

SEQ ID NO: 2732 - protein, 8 aa, Artificial Sequence
  synthetic
GGSISSYY

SEQ ID NO: 2733 - DNA, 21 bp, Artificial Sequence
  synthetic
atctattacagtgggagcacc

SEQ ID NO: 2734 - protein, 7 aa, Artificial Sequence
  synthetic
IYYSGST

SEQ ID NO: 2735 - DNA, 57 bp, Artificial Sequence
  synthetic
gcgagagatacccagtattactttgatagtagtggttattacgggggttttgactac

SEQ ID NO: 2736 - protein, 19 aa, Artificial Sequence
  synthetic
ARDTQYYFDSSGYYGGFDY

SEQ ID NO: 2737 - DNA, 342 bp, Artificial Sequence
  synthetic
gacatcctgatgacccagtctccagactccctggctgtgtctctgggcgagagggccaccatcaactgcaagtccagccagagtgttttatacagatccaacaataagaactacttagcttggtaccaccagaaaccaggacagcctcctaagctgctcatttactgggcatctacccgggaatccggggtccctgaccgattcagtggcagcgggtctgggacagatttcactctcaccatcagcagcctgcaggctgaagatgtggcaatttattactgtcaacaatattataatactccgtacacttttggccaggggaccaaggtggagatcaaacga

SEQ ID NO: 2738 - protein, 114 aa, Artificial Sequence
  synthetic
DILMTQSPDSLAVSLGERATINCKSSQSVLYRSNNKNYLAWYHQKPGQPPKLLIYWASTRESGVPDRFSGSGSGTDFTLTISSLQAEDVAIYYCQQYYNTPYTFGQGTKVEIKR

SEQ ID NO: 2739 - DNA, 36 bp, Artificial Sequence
  synthetic
cagagtgttttatacagatccaacaataagaactac

SEQ ID NO: 2740 - protein, 12 aa, Artificial Sequence
  synthetic
QSVLYRSNNKNY

SEQ ID NO: 2741 - DNA, 9 bp, Artificial Sequence
  synthetic
tgggcatct

SEQ ID NO: 2742 - protein, 3 aa, Artificial Sequence
  synthetic
WAS

SEQ ID NO: 2743 - DNA, 27 bp, Artificial Sequence
  synthetic
caacaatattataatactccgtacact

SEQ ID NO: 2744 - protein, 9 aa, Artificial Sequence
  synthetic
QQYYNTPYT

SEQ ID NO: 2745 - DNA, 366 bp, Artificial Sequence
  synthetic
gaggtgcagctggtggagtctggagcagaggtgaaaaagcccggggagtctctgaagatctcctgtaagggttctggatacacctttaccaactactggatcggctgggtgcgccagatgcccgggaaaggcctggagtggatggggatcatctatccaggtgactctgagaccagatacagtccgtccttccaaggccaggtcaccatctcagccgacaagtccatcagcaccgcctacctgcagtggagtagcctgaaggcctcggacaccgccttattttactgtgcgagacttgggaggttcttcgacaactactacgctatggacgtctggggccaagggaccacggtcaccgtctcctca

SEQ ID NO: 2746 - protein, 122 aa, Artificial Sequence; identical to SEQ ID NO: 2602
  synthetic

SEQ ID NO: 2747 - DNA, 24 bp, Artificial Sequence
  synthetic
ggatacacctttaccaactactgg

SEQ ID NO: 2748 - protein, 8 aa, Artificial Sequence
  synthetic
GYTFTNYW

SEQ ID NO: 2749 - DNA, 24 bp, Artificial Sequence
  synthetic
atctatccaggtgactctgagacc

SEQ ID NO: 2750 - protein, 8 aa, Artificial Sequence
  synthetic
IYPGDSET

SEQ ID NO: 2751 - DNA, 45 bp, Artificial Sequence; identical to SEQ ID NO: 2607
  synthetic

SEQ ID NO: 2752 - protein, 15 aa, Artificial Sequence
  synthetic
ARLGRFFDNYYAMDV

SEQ ID NO: 2753 - DNA, 324 bp, Artificial Sequence
  synthetic
gacatcctgatgacccagtctccatcctccctgtctgcatctgtaggagacagagtcaccatcacttgtcgggcaagtcagagcattagcacctatttaaattggtatcagcagaaaccagggaaagcccctaagctcctgatctatggtgcgtccagtttgcaaagtggggtcccatcaaggttcagtggcagtggatctgggacagatttcactctcaccatcagcagtctgcaatttgcagattttgaaaattactactgtcaacagacttacagtatcccgtacacttttggccaggggaccaaggtggagatcaaacga

SEQ ID NO: 2754 - protein, 108 aa, Artificial Sequence
  synthetic
DILMTQSPSSLSASVGDRVTITCRASQSISTYLNWYQQKPGKAPKLLIYGASSLQSGVPSRFSGSGSGTDFTLTISSLQFADFENYYCQQTYSIPYTFGQGTKVEIKR

SEQ ID NO: 2755 - DNA, 18 bp, Artificial Sequence
  synthetic
cagagcattagcacctat

SEQ ID NO: 2756 - protein, 6 aa, Artificial Sequence
  synthetic
QSISTY

SEQ ID NO: 2757 - DNA, 9 bp, Artificial Sequence
  synthetic
ggtgcgtcc

SEQ ID NO: 2758 - protein, 3 aa, Artificial Sequence
  synthetic
GAS

SEQ ID NO: 2759 - DNA, 27 bp, Artificial Sequence
  synthetic
caacagacttacagtatcccgtacact

SEQ ID NO: 2760 - protein, 9 aa, Artificial Sequence
  synthetic
QQTYSIPYT

SEQ ID NO: 2761 - DNA, 357 bp, Artificial Sequence
  synthetic
gaggtgcagctggtggagtctgggggaggcgtggtccagcctgggaggtccctgagactctcctgtgcagcgtctggattcaccttcagtgactatggcatgcactgggtccggcaggctccaggcaaggggctggagtgggtggcagttatttggtatgatggaaataaaaaagactgtgtagactccgtgaagggccgattcaccatctccagagacaattccaagaacacactgtatctacaaatgaatagcctgagagccgaggacacggctgtgtattactgtgcgagaatgaggtataactggaactcatttgactactggggccagggaaccctggtcaccgtctcctca

SEQ ID NO: 2762 - protein, 119 aa, Artificial Sequence
  synthetic
EVQLVESGGGVVQPGRSLRLSCAASGFTFSDYGMHWVRQAPGKGLEWVAVIWYDGNKKDCVDSVKGRFTISRDNSKNTLYLQMNSLRAEDTAVYYCARMRYNWNSFDYWGQGTLVTVSS

SEQ ID NO: 2763 - DNA, 24 bp, Artificial Sequence
  synthetic
ggattcaccttcagtgactatggc

SEQ ID NO: 2764 - protein, 8 aa, Artificial Sequence
  synthetic
GFTFSDYG

SEQ ID NO: 2765 - DNA, 24 bp, Artificial Sequence
  synthetic
atttggtatgatggaaataaaaaa

SEQ ID NO: 2766 - protein, 8 aa, Artificial Sequence
  synthetic
IWYDGNKK

SEQ ID NO: 2767 - DNA, 36 bp, Artificial Sequence; identical to SEQ ID NO: 2575
  synthetic

SEQ ID NO: 2768 - protein, 12 aa, Artificial Sequence
  synthetic
ARMRYNWNSFDY

SEQ ID NO: 2769 - DNA, 324 bp, Artificial Sequence
  synthetic
gacatcctgatgacccagtctccatcctccctgtctgcatctgtaggagacagagtcaccatcacttgccaggcgagtcaggtcactcacaactatttaaattggtatcagcagaaaccagggaaatcccctaagctcctgatctacgatgcatccaatttggaaacaggggtcccatcaaggttcagtggaagtggatctgggacagattttactttcaccatcagcagcctgcagcctgaagatattgcaacatatttctgtcaacagtatgttaatttccctctcactttcggcggagggaccaaggtggagatcaaacga

SEQ ID NO: 2770 - protein, 108 aa, Artificial Sequence
  synthetic
DILMTQSPSSLSASVGDRVTITCQASQVTHNYLNWYQQKPGKSPKLLIYDASNLETGVPSRFSGSGSGTDFTFTISSLQPEDIATYFCQQYVNFPLTFGGGTKVEIKR

SEQ ID NO: 2771 - DNA, 18 bp, Artificial Sequence
  synthetic
caggtcactcacaactat

SEQ ID NO: 2772 - protein, 6 aa, Artificial Sequence
  synthetic
QVTHNY

SEQ ID NO: 2773 - DNA, 9 bp, Artificial Sequence
  synthetic
gatgcatcc

SEQ ID NO: 2774 - protein, 3 aa, Artificial Sequence
  synthetic
DAS

SEQ ID NO: 2775 - DNA, 27 bp, Artificial Sequence
  synthetic
caacagtatgttaatttccctctcact

SEQ ID NO: 2776 - protein, 9 aa, Artificial Sequence
  synthetic
QQYVNFPLT

SEQ ID NO: 2777 - DNA, 357 bp, Artificial Sequence
  synthetic
gaggtgcagctggtggagtctgggggaggcgtggtccagcctgggaggtccctgagactctcctgtgcagcgtctggattcaccttcagtgactatggcatgcactgggtccggcaggctccaggcaaggggctggagtgggtggcagttatttggtatgatggatataaaaaagactgtatagactccgtgaagggccgattcaccatctccagagacaattccaagaacacgctatatctacaaatgaatagcctgagagccgaggacacggctttttattactgtgcgagaatgaggtataactggaacgcgtttgacttctggggccagggaaccatggtcaccgtctcctca

SEQ ID NO: 2778 - protein, 119 aa, Artificial Sequence
  synthetic
EVQLVESGGGVVQPGRSLRLSCAASGFTFSDYGMHWVRQAPGKGLEWVAVIWYDGYKKDCIDSVKGRFTISRDNSKNTLYLQMNSLRAEDTAFYYCARMRYNWNAFDFWGQGTMVTVSS

SEQ ID NO: 2779 - DNA, 24 bp, Artificial Sequence
  synthetic
ggattcaccttcagtgactatggc

SEQ ID NO: 2780 - protein, 8 aa, Artificial Sequence
  synthetic
GFTFSDYG

SEQ ID NO: 2781 - DNA, 24 bp, Artificial Sequence
  synthetic
atttggtatgatggatataaaaaa

SEQ ID NO: 2782 - protein, 8 aa, Artificial Sequence
  synthetic
IWYDGYKK

SEQ ID NO: 2783 - DNA, 36 bp, Artificial Sequence
  synthetic
gcgagaatgaggtataactggaacgcgtttgacttc

SEQ ID NO: 2784 - protein, 12 aa, Artificial Sequence
  synthetic
ARMRYNWNAFDF

SEQ ID NO: 2785 - DNA, 324 bp, Artificial Sequence
  synthetic
gacatcctgatgacccagtctccatcctccctgtctgcatctgtaggagacagagtcaccatcacttgccaggcgagtcaggacactcacaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatatttctgtcaacagtatgttaatttccctctcactttcggcggagggaccaaggtggagatcaaacga

SEQ ID NO: 2786 - protein, 108 aa, Artificial Sequence
  synthetic
DILMTQSPSSLSASVGDRVTITCQASQDTHNYLNWYQQKPGKAPKLLIYDASNLETGVPSRFSGSGSGTDFTFTISSLQPEDIATYFCQQYVNFPLTFGGGTKVEIKR

SEQ ID NO: 2787 - DNA, 18 bp, Artificial Sequence
  synthetic
caggacactcacaactat

SEQ ID NO: 2788 - protein, 6 aa, Artificial Sequence
  synthetic
QDTHNY

SEQ ID NO: 2789 - DNA, 9 bp, Artificial Sequence
  synthetic
gatgcatcc

SEQ ID NO: 2790 - protein, 3 aa, Artificial Sequence
  synthetic
DAS

SEQ ID NO: 2791 - DNA, 27 bp, Artificial Sequence
  synthetic
caacagtatgttaatttccctctcact

SEQ ID NO: 2792 - protein, 9 aa, Artificial Sequence
  synthetic
QQYVNFPLT

SEQ ID NO: 2793 - DNA, 366 bp, Artificial Sequence
  synthetic
caggtgcagctggtggagtctggagcagaggtgaaaaagcccggggagtctctgaagatctcctgtaagggttctggatacacctttaccaactactggatcggctgggtgcgccagatgcccgggaaaggcctggagtggatggggatcatctatccaggtgactctgagaccagatacagtccgtccttccaaggccaggtcaccatctcagccgacaagtccatcagcaccgcctacctgcagtggagcagcctgaaggcctcggacaccgccttattttactgtgcgaaacttgggaggttcttcgacaactactacgctatggacgtctggggccaagggaccacggtcaccgtctcctca

SEQ ID NO: 2794 - protein, 122 aa, Artificial Sequence
  synthetic
QVQLVESGAEVKKPGESLKISCKGSGYTFTNYWIGWVRQMPGKGLEWMGIIYPGDSETRYSPSFQGQVTISADKSISTAYLQWSSLKASDTALFYCAKLGRFFDNYYAMDVWGQGTTVTVSS

SEQ ID NO: 2795 - DNA, 24 bp, Artificial Sequence
  synthetic
ggatacacctttaccaactactgg

SEQ ID NO: 2796 - protein, 8 aa, Artificial Sequence
  synthetic
GYTFTNYW

SEQ ID NO: 2797 - DNA, 24 bp, Artificial Sequence
  synthetic
atctatccaggtgactctgagacc

SEQ ID NO: 2798 - protein, 8 aa, Artificial Sequence
  synthetic
IYPGDSET

SEQ ID NO: 2799 - DNA, 45 bp, Artificial Sequence
  synthetic
gcgaaacttgggaggttcttcgacaactactacgctatggacgtc

SEQ ID NO: 2800 - protein, 15 aa, Artificial Sequence
  synthetic
AKLGRFFDNYYAMDV

SEQ ID NO: 2801 - DNA, 324 bp, Artificial Sequence
  synthetic
gacatcctgatgacccagtctccatcctccctgtctgcatctgtaggagacagagtcaccatcacttgtcgggcaagtcagagcattagcacctatttaaattggtatcagcagaaaccagggaaagcccctaaactcctgatctatggtgcgtccagtttgcaaagtggggtcccatcaaggttcagtggcagtggatctgggacagatttcactctcaccatcagcagtctgcaatttgcagattttgaaaattactactgtcaacagacttacagtatcccgtacacttttggccaggggaccaagctggagatcaaacga

SEQ ID NO: 2802 - protein, 108 aa, Artificial Sequence
  synthetic
DILMTQSPSSLSASVGDRVTITCRASQSISTYLNWYQQKPGKAPKLLIYGASSLQSGVPSRFSGSGSGTDFTLTISSLQFADFENYYCQQTYSIPYTFGQGTKLEIKR

SEQ ID NO: 2803 - DNA, 18 bp, Artificial Sequence
  synthetic
cagagcattagcacctat

SEQ ID NO: 2804 - protein, 6 aa, Artificial Sequence
  synthetic
QSISTY

SEQ ID NO: 2805 - DNA, 9 bp, Artificial Sequence
  synthetic
ggtgcgtcc

SEQ ID NO: 2806 - protein, 3 aa, Artificial Sequence
  synthetic
GAS

SEQ ID NO: 2807 - DNA, 27 bp, Artificial Sequence
  synthetic
caacagacttacagtatcccgtacact

SEQ ID NO: 2808 - protein, 9 aa, Artificial Sequence
  synthetic
QQTYSIPYT

SEQ ID NO: 2809 - DNA, 366 bp, Artificial Sequence; identical to SEQ ID NO: 2601
  synthetic

SEQ ID NO: 2810 - protein, 122 aa, Artificial Sequence; identical to SEQ ID NO: 2602
  synthetic

SEQ ID NO: 2811 - DNA, 24 bp, Artificial Sequence
  synthetic
ggatacacctttaccaactactgg

SEQ ID NO: 2812 - protein, 8 aa, Artificial Sequence
  synthetic
GYTFTNYW

SEQ ID NO: 2813 - DNA, 24 bp, Artificial Sequence
  synthetic
atctatccaggtgactctgagacc

SEQ ID NO: 2814 - protein, 8 aa, Artificial Sequence
  synthetic
IYPGDSET

SEQ ID NO: 2815 - DNA, 45 bp, Artificial Sequence; identical to SEQ ID NO: 2607
  synthetic

SEQ ID NO: 2816 - protein, 15 aa, Artificial Sequence
  synthetic
ARLGRFFDNYYAMDV

SEQ ID NO: 2817 - DNA, 324 bp, Artificial Sequence
  synthetic
gacatcctgatgacccagtctccatcctccctgtctgcatctgtaggagacagagtcattatcacttgtcgggcaagtcagagcattagcacctatttaaattggtatcagcagaaaccagggaaagcccctaagctcctgatctatggtgcgtccagtttgcaaagtggggtcccatcaaggttcagtggcagtggatctgggacagatttcactctcaccatcagcagtctgcaatttgcagattttgaaaattactactgtcaacagacttacagtatcccgtacacttttggccaggggaccaaggtggagatcaaacga

SEQ ID NO: 2818 - protein, 108 aa, Artificial Sequence
  synthetic
DILMTQSPSSLSASVGDRVIITCRASQSISTYLNWYQQKPGKAPKLLIYGASSLQSGVPSRFSGSGSGTDFTLTISSLQFADFENYYCQQTYSIPYTFGQGTKVEIKR

SEQ ID NO: 2819 - DNA, 18 bp, Artificial Sequence
  synthetic
cagagcattagcacctat

SEQ ID NO: 2820 - protein, 6 aa, Artificial Sequence
  synthetic
QSISTY

SEQ ID NO: 2821 - DNA, 9 bp, Artificial Sequence
  synthetic
ggtgcgtcc

SEQ ID NO: 2822 - protein, 3 aa, Artificial Sequence
  synthetic
GAS

SEQ ID NO: 2823 - DNA, 27 bp, Artificial Sequence
  synthetic
caacagacttacagtatcccgtacact

SEQ ID NO: 2824 - protein, 9 aa, Artificial Sequence
  synthetic
QQTYSIPYT

SEQ ID NO: 2825 - DNA, 354 bp, Artificial Sequence
  synthetic
caggtgcagctggtggagtctgggggaggcgtggtccagcctgggaggtccctgagactctcctgtgcagcgtctggattcaccttcagtaactatggcatgcactgggtccgccaggctcccggcaaggggctggaatgggtggcacttatatggtttgatggaagtaataaaaactatgcagactccgtgacgggccgattcaccatctccagagacaattccaagaatacgctgtatctgcaaatgaacaggctgagagccgaggacacggctgtatactactgtgcgacagaaatagcagctcgtccctttgaatattggggccagggaatcctggtcaccgtctcctca

SEQ ID NO: 2826 - protein, 118 aa, Artificial Sequence
  synthetic
QVQLVESGGGVVQPGRSLRLSCAASGFTFSNYGMHWVRQAPGKGLEWVALIWFDGSNKNYADSVTGRFTISRDNSKNTLYLQMNRLRAEDTAVYYCATEIAARPFEYWGQGILVTVSS

SEQ ID NO: 2827 - DNA, 24 bp, Artificial Sequence
  synthetic
ggattcaccttcagtaactatggc

SEQ ID NO: 2828 - protein, 8 aa, Artificial Sequence
  synthetic
GFTFSNYG

SEQ ID NO: 2829 - DNA, 24 bp, Artificial Sequence
  synthetic
atatggtttgatggaagtaataaa

SEQ ID NO: 2830 - protein, 8 aa, Artificial Sequence
  synthetic
IWFDGSNK

SEQ ID NO: 2831 - DNA, 33 bp, Artificial Sequence
  synthetic
gcgacagaaatagcagctcgtccctttgaatat

SEQ ID NO: 2832 - protein, 11 aa, Artificial Sequence
  synthetic
ATEIAARPFEY

SEQ ID NO: 2833 - DNA, 339 bp, Artificial Sequence
  synthetic
gacatcgtgatgacccagtctccactctccctgcccgtcactcctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgtacacttttggccaggggaccaaggtggagatcaaacga

SEQ ID NO: 2834 - protein, 113 aa, Artificial Sequence
  synthetic
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKR

SEQ ID NO: 2835 - DNA, 33 bp, Artificial Sequence; identical to SEQ ID NO: 2259
  synthetic

SEQ ID NO: 2836 - protein, 11 aa, Artificial Sequence
  synthetic
QSLLHSNGYNY

SEQ ID NO: 2837 - DNA, 9 bp, Artificial Sequence
  synthetic
ttgggttct

SEQ ID NO: 2838 - protein, 3 aa, Artificial Sequence
  synthetic
LGS

SEQ ID NO: 2839 - DNA, 27 bp, Artificial Sequence
  synthetic
atgcaagctctacaaactccgtacact

SEQ ID NO: 2840 - protein, 9 aa, Artificial Sequence
  synthetic
MQALQTPYT

SEQ ID NO: 2841 - DNA, 369 bp, Artificial Sequence
  synthetic
caggtgcagctggtggagtcaggtccaggactggtgaagccctcgcagaccctctcactcacctgtgccatctccggggacagtgtctctaggatcaatgttgcttggaactggatcaggcagtccccatcgagaggccttgagtggctgggaaggacatactacaggtccacgtggtttaatgattatgcagtatctgtgaaaagtcgaataaccatcactcccgacacatccaagaaccagttctccctgcagctgaactctgtgactcccgaggacacggctgtctattactgtacaagagctggaactacgttttactggtacttcgatctctggggccgtggcaccctggtcaccgtctcctca

SEQ ID NO: 2842 - protein, 123 aa, Artificial Sequence
  synthetic
QVQLVESGPGLVKPSQTLSLTCAISGDSVSRINVAWNWIRQSPSRGLEWLGRTYYRSTWFNDYAVSVKSRITITPDTSKNQFSLQLNSVTPEDTAVYYCTRAGTTFYWYFDLWGRGTLVTVSS

SEQ ID NO: 2843 - DNA, 30 bp, Artificial Sequence
  synthetic
ggggacagtgtctctaggatcaatgttgct

SEQ ID NO: 2844 - protein, 10 aa, Artificial Sequence
  synthetic
GDSVSRINVA

SEQ ID NO: 2845 - DNA, 27 bp, Artificial Sequence
  synthetic
acatactacaggtccacgtggtttaat

SEQ ID NO: 2846 - protein, 9 aa, Artificial Sequence
  synthetic
TYYRSTWFN

SEQ ID NO: 2847 - DNA, 39 bp, Artificial Sequence
  synthetic
acaagagctggaactacgttttactggtacttcgatctc

SEQ ID NO: 2848 - protein, 13 aa, Artificial Sequence
  synthetic
TRAGTTFYWYFDL

SEQ ID NO: 2849 - DNA, 321 bp, Artificial Sequence
  synthetic
gacatcctgatgacccagtctccttccaccctgtctgcatctgtaggagacagagtcaccatcacttgccgggccagtcagggtattggtagctggttggcctggtatcagcagaaaccagggaaagcccctaaactcctgatctataaggcgtctagtttagaaagtggggtcccatcaaggttcagcggcagtggatctgggacagaattcactctcaccatcagcagcctgcagcctgatgattgtgcaacttattactgccaacagtatgatacttattacacttttggccaggggaccaaggtggagatcaaacga

SEQ ID NO: 2850 - protein, 107 aa, Artificial Sequence
  synthetic
DILMTQSPSTLSASVGDRVTITCRASQGIGSWLAWYQQKPGKAPKLLIYKASSLESGVPSRFSGSGSGTEFTLTISSLQPDDCATYYCQQYDTYYTFGQGTKVEIKR

SEQ ID NO: 2851 - DNA, 18 bp, Artificial Sequence
  synthetic
cagggtattggtagctgg

SEQ ID NO: 2852 - protein, 6 aa, Artificial Sequence
  synthetic
QGIGSW

SEQ ID NO: 2853 - DNA, 9 bp, Artificial Sequence
  synthetic
aaggcgtct

SEQ ID NO: 2854 - protein, 3 aa, Artificial Sequence
  synthetic
KAS

SEQ ID NO: 2855 - DNA, 24 bp, Artificial Sequence
  synthetic
caacagtatgatacttattacact

SEQ ID NO: 2856 - protein, 8 aa, Artificial Sequence
  synthetic
QQYDTYYT

SEQ ID NO: 2857 - DNA, 369 bp, Artificial Sequence
  synthetic
caggtgcagctggtggagtcaggtccaggactggtgaagccctcgcagaccctctcactcacctgtgccatctccggggacagtgtctctaggatcaatgttgcttggaactggatcaggcagtccccatcgagaggccttgagtggctgggaaggacatactacaggtccacgtggtttaatgattatgcagtgtctgtgaaaagtcgaataaccatcactcccgacacatccaagaaccagttctccctgcaactgaactctgtgactcccgaggacacggctgtctattactgtacaagagctggaactacgttttactggtacttcgatctctggggccgtggcaccctggtcaccgtctcctca

SEQ ID NO: 2858 - protein, 123 aa, Artificial Sequence; identical to SEQ ID NO: 2842
  synthetic

SEQ ID NO: 2859 - DNA, 30 bp, Artificial Sequence; identical to SEQ ID NO: 2843
  synthetic

SEQ ID NO: 2860 - protein, 10 aa, Artificial Sequence
  synthetic
GDSVSRINVA

SEQ ID NO: 2861 - DNA, 27 bp, Artificial Sequence
  synthetic
acatactacaggtccacgtggtttaat

SEQ ID NO: 2862 - protein, 9 aa, Artificial Sequence
  synthetic
TYYRSTWFN

SEQ ID NO: 2863 - DNA, 39 bp, Artificial Sequence; identical to SEQ ID NO: 2847
  synthetic

SEQ ID NO: 2864 - protein, 13 aa, Artificial Sequence
  synthetic
TRAGTTFYWYFDL

SEQ ID NO: 2865 - DNA, 321 bp, Artificial Sequence
  synthetic
gacatcctgatgacccagtctccttccaccctgtctgcatctgtaggagacagagtcaccatcacttgccgggccagtcagggtattggtagctggttggcctggtatcagcagaaaccagggaaagcccctaaactcctgatctataaggcgtctagtttagaaagtggggtcccatcaaggttcagcggcagtggatctgggacagaattcactctcaccatcagcagcctgcagcctgatgattgtgcatcttattactgccaacagtatgatacttattacacttttggccaggggaccaaggtggagatcaaacga

SEQ ID NO: 2866 - protein, 107 aa, Artificial Sequence
  synthetic
DILMTQSPSTLSASVGDRVTITCRASQGIGSWLAWYQQKPGKAPKLLIYKASSLESGVPSRFSGSGSGTEFTLTISSLQPDDCASYYCQQYDTYYTFGQGTKVEIKR

SEQ ID NO: 2867 - DNA, 18 bp, Artificial Sequence
  synthetic
cagggtattggtagctgg

SEQ ID NO: 2868 - protein, 6 aa, Artificial Sequence
  synthetic
QGIGSW

SEQ ID NO: 2869 - DNA, 9 bp, Artificial Sequence
  synthetic
aaggcgtct

SEQ ID NO: 2870 - protein, 3 aa, Artificial Sequence
  synthetic
KAS

SEQ ID NO: 2871 - DNA, 24 bp, Artificial Sequence
  synthetic
caacagtatgatacttattacact

SEQ ID NO: 2872 - protein, 8 aa, Artificial Sequence
  synthetic
QQYDTYYT

SEQ ID NO: 2873 - DNA, 363 bp, Artificial Sequence
  synthetic
gaggtgcagctggtggagtctggagcagaggtcaagaagcccggggagtctctgaagatctcctgtaaggtttctggatacagttttaccaactactggatcggctgggtgcgccagatgcccgggaaaggcctggagtggatggggatcatctatcctagtgactctgataccagatacagcccgtccttccaaggccaggtcaccatctcagccgacaagtccaatagcaccgcctacctacagtggaccagcctgaaggccgcggacaccgccatgtatttctgtgcgaggtcggcaaatttttggagtggttatccctttgactactggggccagggaaccctggtcaccgtctcctca

SEQ ID NO: 2874 - protein, 121 aa, Artificial Sequence
  synthetic
EVQLVESGAEVKKPGESLKISCKVSGYSFTNYWIGWVRQMPGKGLEWMGIIYPSDSDTRYSPSFQGQVTISADKSNSTAYLQWTSLKAADTAMYFCARSANFWSGYPFDYWGQGTLVTVSS

SEQ ID NO: 2875 - DNA, 24 bp, Artificial Sequence
  synthetic
ggatacagttttaccaactactgg

SEQ ID NO: 2876 - protein, 8 aa, Artificial Sequence
  synthetic
GYSFTNYW

SEQ ID NO: 2877 - DNA, 24 bp, Artificial Sequence
  synthetic
atctatcctagtgactctgatacc

SEQ ID NO: 2878 - protein, 8 aa, Artificial Sequence
  synthetic
IYPSDSDT

SEQ ID NO: 2879 - DNA, 42 bp, Artificial Sequence
  synthetic
gcgaggtcggcaaatttttggagtggttatccctttgactac

SEQ ID NO: 2880 - protein, 14 aa, Artificial Sequence
  synthetic
ARSANFWSGYPFDY

SEQ ID NO: 2881 - DNA, 324 bp, Artificial Sequence
  synthetic
gacatcctgatgacccagtctccatcctccctgtctgcatctgttggagacagagtcaccatcacttgccgggcaagtcagagcattagtagatatttaaattggtatcagcagaaaccagggaaagcccctaaactcctgatctatgttgcatccagtttgcaaagtggggtcccatcaaggttcagtggcagtggatccgggacagatttcactctcaccatcaacagtctgcaacctgaagattttgcaacttactattgtcaacagacttacagtatcccgtacacatttggccaggggaccaaggtggagatcaaacga

SEQ ID NO: 2882 - protein, 108 aa, Artificial Sequence
  synthetic
DILMTQSPSSLSASVGDRVTITCRASQSISRYLNWYQQKPGKAPKLLIYVASSLQSGVPSRFSGSGSGTDFTLTINSLQPEDFATYYCQQTYSIPYTFGQGTKVEIKR

SEQ ID NO: 2883 - DNA, 18 bp, Artificial Sequence
  synthetic
cagagcattagtagatat

SEQ ID NO: 2884 - protein, 6 aa, Artificial Sequence
  synthetic
QSISRY

SEQ ID NO: 2885 - DNA, 9 bp, Artificial Sequence
  synthetic
gttgcatcc

SEQ ID NO: 2886 - protein, 3 aa, Artificial Sequence
  synthetic
VAS

SEQ ID NO: 2887 - DNA, 27 bp, Artificial Sequence
  synthetic
caacagacttacagtatcccgtacaca

SEQ ID NO: 2888 - protein, 9 aa, Artificial Sequence
  synthetic
QQTYSIPYT

SEQ ID NO: 2889 - DNA, 354 bp, Artificial Sequence
  synthetic
gaggtgcagctggtggagtctgggggaggcgtggtccagcctgggaggtccctgagactctcctgtgcagcgtctggattcaccttcagtacctatggcatgcattgggtccgccaggctccaggcaagggactggagtgggtggcccttatatggtatgacggaactaataaaaactatgcagattccgtgacgggccgattcaccatctccagagacaattccaagaacacattgtatctgcaaatgaacagcctgagagccgaggacacggctgtgtattactgtgcgacagaaatagcagctcgtccctttgaatactggggccagggaaccctggtcaccgtctcctca

SEQ ID NO: 2890 - protein, 118 aa, Artificial Sequence
  synthetic
EVQLVESGGGVVQPGRSLRLSCAASGFTFSTYGMHWVRQAPGKGLEWVALIWYDGTNKNYADSVTGRFTISRDNSKNTLYLQMNSLRAEDTAVYYCATEIAARPFEYWGQGTLVTVSS

SEQ ID NO: 2891 - DNA, 24 bp, Artificial Sequence
  synthetic
ggattcaccttcagtacctatggc

SEQ ID NO: 2892 - protein, 8 aa, Artificial Sequence
  synthetic
GFTFSTYG

SEQ ID NO: 2893 - DNA, 24 bp, Artificial Sequence
  synthetic
atatggtatgacggaactaataaa

SEQ ID NO: 2894 - protein, 8 aa, Artificial Sequence
  synthetic
IWYDGTNK

SEQ ID NO: 2895 - DNA, 33 bp, Artificial Sequence
  synthetic
gcgacagaaatagcagctcgtccctttgaatac

SEQ ID NO: 2896 - protein, 11 aa, Artificial Sequence
  synthetic
ATEIAARPFEY

SEQ ID NO: 2897 - DNA, 339 bp, Artificial Sequence
  synthetic
gacatcgtgatgacccagtctccactctccctgcccgtcactcctggagagccggcctccatctcctgcaggtctactcagagcctcctacagattaatggatacaactatttggattggtacctgcagaagccagggcagtctccacagctcctgatctatttgggttctaatcgggcctccggggtccctgacaggttcagtggcagtggagcaggcacagattttacactgaagatcagcagagtggaggctgaggatgttggggtttattactgcatgcaagctcttcaaactccgtacacttttggccaggggaccaaggtggagatcaaacga

SEQ ID NO: 2898 - protein, 113 aa, Artificial Sequence
  synthetic
DIVMTQSPLSLPVTPGEPASISCRSTQSLLQINGYNYLDWYLQKPGQSPQLLIYLGSNRASGVPDRFSGSGAGTDFTLKISRVEAEDVGVYYCMQALQTPYTFGQGTKVEIKR

SEQ ID NO: 2899 - DNA, 33 bp, Artificial Sequence
  synthetic
cagagcctcctacagattaatggatacaactat

SEQ ID NO: 2900 - protein, 11 aa, Artificial Sequence
  synthetic
QSLLQINGYNY

SEQ ID NO: 2901 - DNA, 9 bp, Artificial Sequence
  synthetic
ttgggttct

SEQ ID NO: 2902 - protein, 3 aa, Artificial Sequence
  synthetic
LGS

SEQ ID NO: 2903 - DNA, 27 bp, Artificial Sequence
  synthetic
atgcaagctcttcaaactccgtacact

SEQ ID NO: 2904 - protein, 9 aa, Artificial Sequence
  synthetic
MQALQTPYT

SEQ ID NO: 2905 - DNA, 354 bp, Artificial Sequence
  synthetic
gaggtgcagctggtggagtctgggggaggcgtggtccagcctgggaggtccctgagactctcctgtgtagcgtctggaatcaccttcagtaactatggcatgcactgggtccgccaggctccaggcaaggggctggagtgggtggcacttatatggtatgatggaagtaataaaaactatgcagattccgtgacgggccgattcatcatctccagagacaattccaagaatacgctgtatctgcaaatgaacagcctgagagccgaggacgcggctgtgtacttctgtgcgacagaaatagcagctcgtccctttgaatactggggccagggaaccctggtcaccgtctcctca

SEQ ID NO: 2906 - protein, 118 aa, Artificial Sequence
  synthetic
EVQLVESGGGVVQPGRSLRLSCVASGITFSNYGMHWVRQAPGKGLEWVALIWYDGSNKNYADSVTGRFIISRDNSKNTLYLQMNSLRAEDAAVYFCATEIAARPFEYWGQGTLVTVSS

SEQ ID NO: 2907 - DNA, 24 bp, Artificial Sequence
  synthetic
ggaatcaccttcagtaactatggc

SEQ ID NO: 2908 - protein, 8 aa, Artificial Sequence
  synthetic
GITFSNYG

SEQ ID NO: 2909 - DNA, 24 bp, Artificial Sequence
  synthetic
atatggtatgatggaagtaataaa

SEQ ID NO: 2910 - protein, 8 aa, Artificial Sequence
  synthetic
IWYDGSNK

SEQ ID NO: 2911 - DNA, 33 bp, Artificial Sequence; identical to SEQ ID NO: 2895
  synthetic

SEQ ID NO: 2912 - protein, 11 aa, Artificial Sequence
  synthetic
ATEIAARPFEY

SEQ ID NO: 2913 - DNA, 339 bp, Artificial Sequence
  synthetic
gacatcgtgatgacccagtctccactctccctgcccgtcactcctggggagccggcctccatctcctgcaggtctagtcagagcctcctgcaaattaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgtacacttttggccaggggaccaaggtggagatcaaacga

SEQ ID NO: 2914 - protein, 113 aa, Artificial Sequence
  synthetic
DIVMTQSPLSLPVTPGEPASISCRSSQSLLQINGYNYLDWYLQKPGQSPQLLIYLGSNRASGVPDRFSGSGSGTDFTLKISRVEAEDVGVYYCMQALQTPYTFGQGTKVEIKR

SEQ ID NO: 2915 - DNA, 33 bp, Artificial Sequence
  synthetic
cagagcctcctgcaaattaatggatacaactat

SEQ ID NO: 2916 - protein, 11 aa, Artificial Sequence
  synthetic
QSLLQINGYNY

SEQ ID NO: 2917 - DNA, 9 bp, Artificial Sequence
  synthetic
ttgggttct

SEQ ID NO: 2918 - protein, 3 aa, Artificial Sequence
  synthetic
LGS

SEQ ID NO: 2919 - DNA, 27 bp, Artificial Sequence
  synthetic
atgcaagctctacaaactccgtacact

SEQ ID NO: 2920 - protein, 9 aa, Artificial Sequence
  synthetic
MQALQTPYT

SEQ ID NO: 2921 - DNA, 354 bp, Artificial Sequence
  synthetic
gaggtgcagctggtggagtctgggggaggcttggtccagcctggggggtccctgagactctcctgtgcagcctctggattcaccttcagtagctatgatatgcactgggtccgccaggctccagggaagggactggaatatgtttcaggtattagtagtaaggggggtagcacatattatgcagactctgtgaagggcagattcaccatctccagagacaattccaagaatatactgtatcttcaaatgggcagactgagacctgaggacatggctgtgtattactgtgcgagagagggacaactttggtactttgactactggggccagggaaccatggtcaccgtctcctca

SEQ ID NO: 2922 - protein, 118 aa, Artificial Sequence
  synthetic
EVQLVESGGGLVQPGGSLRLSCAASGFTFSSYDMHWVRQAPGKGLEYVSGISSKGGSTYYADSVKGRFTISRDNSKNILYLQMGRLRPEDMAVYYCAREGQLWYFDYWGQGTMVTVSS

SEQ ID NO: 2923 - DNA, 24 bp, Artificial Sequence
  synthetic
ggattcaccttcagtagctatgat

SEQ ID NO: 2924 - protein, 8 aa, Artificial Sequence
  synthetic
GFTFSSYD

SEQ ID NO: 2925 - DNA, 24 bp, Artificial Sequence
  synthetic
attagtagtaaggggggtagcaca

SEQ ID NO: 2926 - protein, 8 aa, Artificial Sequence
  synthetic
ISSKGGST

SEQ ID NO: 2927 - DNA, 33 bp, Artificial Sequence
  synthetic
gcgagagagggacaactttggtactttgactac

SEQ ID NO: 2928 - protein, 11 aa, Artificial Sequence
  synthetic
AREGQLWYFDY

SEQ ID NO: 2929 - DNA, 324 bp, Artificial Sequence
  synthetic
gacatcgtgatgacccagtctccagccaccctgtctttgtctccaggggaaagagccaccctctcctgcagggccagtcagagtgttagtagctacttagcctggtaccaacagaaacctggccaggctcccagactcctcatctatgctgcatccaacagggccactggcatcccagccaggttcagtggcagtgggtctgggacagacttcactctcaccatcagcagcctagagcctgaagattttgcagtttattactgtcagcagcgttccaactggcctctcactttcggccctgggaccaaggtggagatcaaacga

SEQ ID NO: 2930 - protein, 108 aa, Artificial Sequence
  synthetic
DIVMTQSPATLSLSPGERATLSCRASQSVSSYLAWYQQKPGQAPRLLIYAASNRATGIPARFSGSGSGTDFTLTISSLEPEDFAVYYCQQRSNWPLTFGPGTKVEIKR

SEQ ID NO: 2931 - DNA, 18 bp, Artificial Sequence
  synthetic
cagagtgttagtagctac

SEQ ID NO: 2932 - protein, 6 aa, Artificial Sequence
  synthetic
QSVSSY

SEQ ID NO: 2933 - DNA, 9 bp, Artificial Sequence
  synthetic
gctgcatcc

SEQ ID NO: 2934 - protein, 3 aa, Artificial Sequence
  synthetic
AAS

SEQ ID NO: 2935 - DNA, 27 bp, Artificial Sequence
  synthetic
cagcagcgttccaactggcctctcact

SEQ ID NO: 2936 - protein, 9 aa, Artificial Sequence
  synthetic
QQRSNWPLT

SEQ ID NO: 2937 - DNA, 363 bp, Artificial Sequence
  synthetic
caggtgcagctggtggagtctggagcagaggtgaaaaagcccggagagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgttttactgtgcgaggtcggaagatttttggagtgcttatccctttgactactggggccagggaaccatggtcaccgtctcctca

SEQ ID NO: 2938 - protein, 121 aa, Artificial Sequence
  synthetic
QVQLVESGAEVKKPGESLKISCKGSGYSFTSYWIGWVRQMPGKGLEWMGIIYPGDSDTRYSPSFQGQVTISADKSISTAYLQWSSLKASDTAMFYCARSEDFWSAYPFDYWGQGTMVTVSS

SEQ ID NO: 2939 - DNA, 24 bp, Artificial Sequence
  synthetic
ggatacagctttaccagctactgg

SEQ ID NO: 2940 - protein, 8 aa, Artificial Sequence
  synthetic
GYSFTSYW

SEQ ID NO: 2941 - DNA, 24 bp, Artificial Sequence
  synthetic
atctatcctggtgactctgatacc

SEQ ID NO: 2942 - protein, 8 aa, Artificial Sequence
  synthetic
IYPGDSDT

SEQ ID NO: 2943 - DNA, 42 bp, Artificial Sequence
  synthetic
gcgaggtcggaagatttttggagtgcttatccctttgactac

SEQ ID NO: 2944 - protein, 14 aa, Artificial Sequence
  synthetic
ARSEDFWSAYPFDY

SEQ ID NO: 2945 - DNA, 324 bp, Artificial Sequence
  synthetic
gacatcctgatgacccagtctccatcctccctgtctgcatctgtaggagacagaatcaccatcacttgccgggcaagtcagagcattagcagctatttaaattggtatcagcagaaaccagggaaagcccctgagctcctgatctatgctgcttccagtttgcagagtggggtcccatcaaggttcagtggcagtggatctgggacagatttcactctcaccatcagcagtctgcaacctgaatattttgcaacttactactgtcaacagagttacagtattccgtatacttttggccaggggaccaaggtggagatcaaacga

SEQ ID NO: 2946 - protein, 108 aa, Artificial Sequence
  synthetic
DILMTQSPSSLSASVGDRITITCRASQSISSYLNWYQQKPGKAPELLIYAASSLQSGVPSRFSGSGSGTDFTLTISSLQPEYFATYYCQQSYSIPYTFGQGTKVEIKR

SEQ ID NO: 2947 - DNA, 18 bp, Artificial Sequence
  synthetic
cagagcattagcagctat

SEQ ID NO: 2948 - protein, 6 aa, Artificial Sequence
  synthetic
QSISSY

SEQ ID NO: 2949 - DNA, 9 bp, Artificial Sequence
  synthetic
gctgcttcc

SEQ ID NO: 2950 - protein, 3 aa, Artificial Sequence
  synthetic
AAS

SEQ ID NO: 2951 - DNA, 27 bp, Artificial Sequence
  synthetic
caacagagttacagtattccgtatact

SEQ ID NO: 2952 - protein, 9 aa, Artificial Sequence
  synthetic
QQSYSIPYT

SEQ ID NO: 2953 - DNA, 354 bp, Artificial Sequence
  synthetic
gaggtgcagctggtggagtctgggggaggcgtggtccagcctgggaggtccctgagactctcctgtgcagcgtctggattcaccttcagtacctatggcatgcattgggtccgccaggctccaggcaaggggctggagtgggtggcccttatatggtatgacggaagtaataaaaactatgcagattccgtgacgggccgattcaccatctccagagacaattccaagaacacattgtatctgcaaatgaacagcctgagagccgaggacacggctgtgtattactgtgcgacagaaatagcagctcgtccctttgaatactggggccagggaaccctggtcaccgtctcctca

SEQ ID NO: 2954 - protein, 118 aa, Artificial Sequence
  synthetic
EVQLVESGGGVVQPGRSLRLSCAASGFTFSTYGMHWVRQAPGKGLEWVALIWYDGSNKNYADSVTGRFTISRDNSKNTLYLQMNSLRAEDTAVYYCATEIAARPFEYWGQGTLVTVSS

SEQ ID NO: 2955 - DNA, 24 bp, Artificial Sequence
  synthetic
ggattcaccttcagtacctatggc

SEQ ID NO: 2956 - protein, 8 aa, Artificial Sequence
  synthetic
GFTFSTYG

SEQ ID NO: 2957 - DNA, 24 bp, Artificial Sequence
  synthetic
atatggtatgacggaagtaataaa

SEQ ID NO: 2958 - protein, 8 aa, Artificial Sequence
  synthetic
IWYDGSNK

SEQ ID NO: 2959 - DNA, 33 bp, Artificial Sequence; identical to SEQ ID NO: 2895
  synthetic

SEQ ID NO: 2960 - protein, 11 aa, Artificial Sequence
  synthetic
ATEIAARPFEY

SEQ ID NO: 2961 - DNA, 339 bp, Artificial Sequence
  synthetic
gacatcgtgatgacccagtctccactctccctgcccgtcactcctggagagccggcctccatctcctgcaggtctactcagagtctcctacaaattaatggatacaactatttggattggtacctgcagaagccagggcagtctccacagctcctgatctatttgggttctaatcgggcctccggggtccctgacaggttcagtggcagtggagcaggcacagattttacactgaagatcagcagagtggaggctgaggatgttggggtttattactgcatgcaagctcttcaaactccgtacacttttggccaggggaccaaggtggagatcaaacga

SEQ ID NO: 2962 - protein, 113 aa, Artificial Sequence; identical to SEQ ID NO: 2898
  synthetic

SEQ ID NO: 2963 - DNA, 33 bp, Artificial Sequence
  synthetic
cagagtctcctacaaattaatggatacaactat

SEQ ID NO: 2964 - protein, 11 aa, Artificial Sequence
  synthetic
QSLLQINGYNY

SEQ ID NO: 2965 - DNA, 9 bp, Artificial Sequence
  synthetic
ttgggttct

SEQ ID NO: 2966 - protein, 3 aa, Artificial Sequence
  synthetic
LGS

SEQ ID NO: 2967 - DNA, 27 bp, Artificial Sequence
  synthetic
atgcaagctcttcaaactccgtacact

SEQ ID NO: 2968 - protein, 9 aa, Artificial Sequence
  synthetic
MQALQTPYT

SEQ ID NO: 2969 - DNA, 354 bp, Artificial Sequence
  synthetic
gaggtgcagctggtggagtctgggggaggcgtggtccagcctggggggtccctgagactctcctgtgcagcgtctggattcaccttcagttcctatggcatgcattgggtccgccaggctccaggcaagggactggagtgggtggcccttatatggtatgacggaagtaataaaaactatgcagattccgtgacgggccgattcaccatctccagagacaattccaagaacacattgtatctgcaaatgaacagcctgagagccgaggacacggctgtttattactgtgcgacagaaatagcagctcgtccctttgaatactggggccagggaaccctggtcaccgtctcctca

SEQ ID NO: 2970 - protein, 118 aa, Artificial Sequence
  synthetic
EVQLVESGGGVVQPGGSLRLSCAASGFTFSSYGMHWVRQAPGKGLEWVALIWYDGSNKNYADSVTGRFTISRDNSKNTLYLQMNSLRAEDTAVYYCATEIAARPFEYWGQGTLVTVSS

SEQ ID NO: 2971 - DNA, 24 bp, Artificial Sequence
  synthetic
ggattcaccttcagttcctatggc

SEQ ID NO: 2972 - protein, 8 aa, Artificial Sequence
  synthetic
GFTFSSYG

SEQ ID NO: 2973 - DNA, 24 bp, Artificial Sequence
  synthetic
atatggtatgacggaagtaataaa

SEQ ID NO: 2974 - protein, 8 aa, Artificial Sequence
  synthetic
IWYDGSNK

SEQ ID NO: 2975 - DNA, 33 bp, Artificial Sequence; identical to SEQ ID NO: 2895
  synthetic

SEQ ID NO: 2976 - protein, 11 aa, Artificial Sequence
  synthetic
ATEIAARPFEY

SEQ ID NO: 2977 - DNA, 339 bp, Artificial Sequence; identical to SEQ ID NO: 2897
  synthetic

SEQ ID NO: 2978 - protein, 113 aa, Artificial Sequence; identical to SEQ ID NO: 2898
  synthetic

SEQ ID NO: 2979 - DNA, 33 bp, Artificial Sequence; identical to SEQ ID NO: 2899
  synthetic

SEQ ID NO: 2980 - protein, 11 aa, Artificial Sequence
  synthetic
QSLLQINGYNY

SEQ ID NO: 2981 - DNA, 9 bp, Artificial Sequence
  synthetic
ttgggttct

SEQ ID NO: 2982 - protein, 3 aa, Artificial Sequence
  synthetic
LGS

SEQ ID NO: 2983 - DNA, 27 bp, Artificial Sequence
  synthetic
atgcaagctcttcaaactccgtacact

SEQ ID NO: 2984 - protein, 9 aa, Artificial Sequence
  synthetic
MQALQTPYT

SEQ ID NO: 2985 - DNA, 354 bp, Artificial Sequence; identical to SEQ ID NO: 2969
  synthetic

SEQ ID NO: 2986 - protein, 118 aa, Artificial Sequence; identical to SEQ ID NO: 2970
  synthetic

SEQ ID NO: 2987 - DNA, 24 bp, Artificial Sequence
  synthetic
ggattcaccttcagttcctatggc

SEQ ID NO: 2988 - protein, 8 aa, Artificial Sequence
  synthetic
GFTFSSYG

SEQ ID NO: 2989 - DNA, 24 bp, Artificial Sequence
  synthetic
atatggtatgacggaagtaataaa

SEQ ID NO: 2990 - protein, 8 aa, Artificial Sequence
  synthetic
IWYDGSNK

SEQ ID NO: 2991 - DNA, 33 bp, Artificial Sequence; identical to SEQ ID NO: 2895
  synthetic

SEQ ID NO: 2992 - protein, 11 aa, Artificial Sequence
  synthetic
ATEIAARPFEY

SEQ ID NO: 2993 - DNA, 339 bp, Artificial Sequence
  synthetic
gacatcgtgatgacccagtctccactctccctgcccgtcactcctggagagccggcctccatctcctgcaggtctactcagagcctcctacagattaatggatacaactatttggattggtacttgcagaagccagggcagtctccacacctcctgatctatttgggttctaatcgggcctccggggtccctgacaggttcagtggcagtggagcaggcacagattttacactgaagatcagcagagtggagcctgatgatgttggggtttattactgcatgcaagctcttcaaactccgtacacttttggccaggggaccaaggtggagatcaaacga

SEQ ID NO: 2994 - protein, 113 aa, Artificial Sequence
  synthetic
DIVMTQSPLSLPVTPGEPASISCRSTQSLLQINGYNYLDWYLQKPGQSPHLLIYLGSNRASGVPDRFSGSGAGTDFTLKISRVEPDDVGVYYCMQALQTPYTFGQGTKVEIKR

SEQ ID NO: 2995 - DNA, 33 bp, Artificial Sequence; identical to SEQ ID NO: 2899
  synthetic

SEQ ID NO: 2996 - protein, 11 aa, Artificial Sequence
  synthetic
QSLLQINGYNY

SEQ ID NO: 2997 - DNA, 9 bp, Artificial Sequence
  synthetic
ttgggttct

SEQ ID NO: 2998 - protein, 3 aa, Artificial Sequence
  synthetic
LGS

SEQ ID NO: 2999 - DNA, 27 bp, Artificial Sequence
  synthetic
atgcaagctcttcaaactccgtacact

SEQ ID NO: 3000 - protein, 9 aa, Artificial Sequence
  synthetic
MQALQTPYT

SEQ ID NO: 3001 - DNA, 387 bp, Artificial Sequence
  synthetic
gaggtgcagctggtggagtctgggggaggcttggttcagccgggggggtccctgagactctcctgtgtagcctctggattcacctttagcatttatggcatgagttgggtccgccaggctccagggaaggggctggagtgggtctcagcttttagtggtcgtggtggtacttcatactacgcagactccgtgaagggccggttcaccatctccagagacaaatccaagaacacgctgtatctggaaatgatgagcctgagagccgaggacacggccgtatattactgtgcgaatgatgatttggattactttggttcgggagtcaggaactactaccactacggtatggacgtctggggccaagggaccacggtcaccgtctcctca

SEQ ID NO: 3002 - protein, 129 aa, Artificial Sequence
  synthetic
EVQLVESGGGLVQPGGSLRLSCVASGFTFSIYGMSWVRQAPGKGLEWVSAFSGRGGTSYYADSVKGRFTISRDKSKNTLYLEMMSLRAEDTAVYYCANDDLDYFGSGVRNYYHYGMDVWGQGTTVTVSS

SEQ ID NO: 3003 - DNA, 24 bp, Artificial Sequence
  synthetic
ggattcacctttagcatttatggc

SEQ ID NO: 3004 - protein, 8 aa, Artificial Sequence
  synthetic
GFTFSIYG

SEQ ID NO: 3005 - DNA, 24 bp, Artificial Sequence
  synthetic
tttagtggtcgtggtggtacttca

SEQ ID NO: 3006 - protein, 8 aa, Artificial Sequence
  synthetic
FSGRGGTS

SEQ ID NO: 3007 - DNA, 21 bp, Artificial Sequence
  synthetic
gcgaatgatgatttggattac

SEQ ID NO: 3008 - protein, 7 aa, Artificial Sequence
  synthetic
ANDDLDY

SEQ ID NO: 3009 - DNA, 324 bp, Artificial Sequence
  synthetic
gacatccagatgacccagtctccaccctccctgtctgtctctcctggagagagagccaccatctcctgcagggctagtcagagcattaacaactatttagactggtaccagcagaaaccagggcaggctccaaagctcctgatctatgctgcatccaatcgggccactggggtcccagccaggttcagtggcagtggatctgggacagatttcactctcacgatcagcagcctgcaggctgaagattttgcagtttattactgtctgcaagctaatcaatctccgttcactttcggccaggggaccaaggtggagatcaaacga

SEQ ID NO: 3010 - protein, 108 aa, Artificial Sequence
  synthetic
DIQMTQSPPSLSVSPGERATISCRASQSINNYLDWYQQKPGQAPKLLIYAASNRATGVPARFSGSGSGTDFTLTISSLQAEDFAVYYCLQANQSPFTFGQGTKVEIKR

SEQ ID NO: 3011 - DNA, 18 bp, Artificial Sequence
  synthetic
cagagcattaacaactat

SEQ ID NO: 3012 - protein, 6 aa, Artificial Sequence
  synthetic
QSINNY

SEQ ID NO: 3013 - DNA, 9 bp, Artificial Sequence
  synthetic
gctgcatcc

SEQ ID NO: 3014 - protein, 3 aa, Artificial Sequence
  synthetic
AAS

SEQ ID NO: 3015 - DNA, 27 bp, Artificial Sequence
  synthetic
ctgcaagctaatcaatctccgttcact

SEQ ID NO: 3016 - protein, 9 aa, Artificial Sequence
  synthetic
LQANQSPFT

SEQ ID NO: 3017 - DNA, 354 bp, Artificial Sequence; identical to SEQ ID NO: 2953
  synthetic

SEQ ID NO: 3018 - protein, 118 aa, Artificial Sequence; identical to SEQ ID NO: 2954
  synthetic

SEQ ID NO: 3019 - DNA, 24 bp, Artificial Sequence
  synthetic
ggattcaccttcagtacctatggc

SEQ ID NO: 3020 - protein, 8 aa, Artificial Sequence
  synthetic
GFTFSTYG

SEQ ID NO: 3021 - DNA, 24 bp, Artificial Sequence
  synthetic
atatggtatgacggaagtaataaa

SEQ ID NO: 3022 - protein, 8 aa, Artificial Sequence
  synthetic
IWYDGSNK

SEQ ID NO: 3023 - DNA, 33 bp, Artificial Sequence; identical to SEQ ID NO: 2895
  synthetic

SEQ ID NO: 3024 - protein, 11 aa, Artificial Sequence
  synthetic
ATEIAARPFEY

SEQ ID NO: 3025 - DNA, 339 bp, Artificial Sequence; identical to SEQ ID NO: 2961
  synthetic

SEQ ID NO: 3026 - protein, 113 aa, Artificial Sequence; identical to SEQ ID NO: 2898
  synthetic

SEQ ID NO: 3027 - DNA, 33 bp, Artificial Sequence; identical to SEQ ID NO: 2963
  synthetic

SEQ ID NO: 3028 - protein, 11 aa, Artificial Sequence
  synthetic
QSLLQINGYNY

SEQ ID NO: 3029 - DNA, 9 bp, Artificial Sequence
  synthetic
ttgggttct

SEQ ID NO: 3030 - protein, 3 aa, Artificial Sequence
  synthetic
LGS

SEQ ID NO: 3031 - DNA, 27 bp, Artificial Sequence
  synthetic
atgcaagctcttcaaactccgtacact

SEQ ID NO: 3032 - protein, 9 aa, Artificial Sequence
  synthetic
MQALQTPYT

SEQ ID NO: 3033 - DNA, 354 bp, Artificial Sequence
  synthetic
gaggtgcagctggtggagtctgggggaggcgtggtccagcctggggggtccctgagactctcctgtgcagcgtctggattcaccttcagttcctatggcatgcattgggtccgccaggctccaggcaagggactggagtgggtggcccttatatggtttgacggaagtaataaaaactatgcagattccgtgacgggccgattcaccatctccagagacaattccaagaacacattgtatctgcaaatgaacagcctgagagccgaggacacggctgtgtattactgtgcgacagaaatagcagctcgtccctttgaatactggggccagggaaccctggtcaccgtctcctca

SEQ ID NO: 3034 - protein, 118 aa, Artificial Sequence
  synthetic
EVQLVESGGGVVQPGGSLRLSCAASGFTFSSYGMHWVRQAPGKGLEWVALIWFDGSNKNYADSVTGRFTISRDNSKNTLYLQMNSLRAEDTAVYYCATEIAARPFEYWGQGTLVTVSS

SEQ ID NO: 3035 - DNA, 24 bp, Artificial Sequence
  synthetic
ggattcaccttcagttcctatggc

SEQ ID NO: 3036 - protein, 8 aa, Artificial Sequence
  synthetic
GFTFSSYG

SEQ ID NO: 3037 - DNA, 24 bp, Artificial Sequence
  synthetic
atatggtttgacggaagtaataaa

SEQ ID NO: 3038 - protein, 8 aa, Artificial Sequence
  synthetic
IWFDGSNK

SEQ ID NO: 3039 - DNA, 33 bp, Artificial Sequence; identical to SEQ ID NO: 2895
  synthetic

SEQ ID NO: 3040 - protein, 11 aa, Artificial Sequence
  synthetic
ATEIAARPFEY

SEQ ID NO: 3041 - DNA, 339 bp, Artificial Sequence
  synthetic
gacatcgtgatgacccagtctccactctccctgtccgtcactcctggagagccggcctccatctcctgcaggtctactcagagcctcctacagattaatggatataactatttggattggtacctgcagaagccagggcagtctccacagctcctgatctatttgggttctaatcgggcctccggggtccctgacaggttcagtggcagtggagcaggcacagattttacactgaagatcagcagagtggaggctgaggatgttggggtttattactgcatgcaagctcttcaaactccgtacacttttggccaggggaccaaggtggagatcaaacga

SEQ ID NO: 3042 - protein, 113 aa, Artificial Sequence
  synthetic
DIVMTQSPLSLSVTPGEPASISCRSTQSLLQINGYNYLDWYLQKPGQSPQLLIYLGSNRASGVPDRFSGSGAGTDFTLKISRVEAEDVGVYYCMQALQTPYTFGQGTKVEIKR

SEQ ID NO: 3043 - DNA, 33 bp, Artificial Sequence
  synthetic
cagagcctcctacagattaatggatataactat

SEQ ID NO: 3044 - protein, 11 aa, Artificial Sequence
  synthetic
QSLLQINGYNY

SEQ ID NO: 3045 - DNA, 9 bp, Artificial Sequence
  synthetic
ttgggttct

SEQ ID NO: 3046 - protein, 3 aa, Artificial Sequence
  synthetic
LGS

SEQ ID NO: 3047 - DNA, 27 bp, Artificial Sequence
  synthetic
atgcaagctcttcaaactccgtacact

SEQ ID NO: 3048 - protein, 9 aa, Artificial Sequence
  synthetic
MQALQTPYT

SEQ ID NO: 3049 - DNA, 354 bp, Artificial Sequence
  synthetic
gaggtgcagctggtggagtctgggggaggcttggtccagcctggggggtccctgagactctcctgtgcagcctctggattcaccttcagtagctatgatatgcactgggtccgccaggctccagggaagggactggaatatgtttcaggtattagtagtaaggggggtagcacatattatgcagactctgtgaagggcagattcaccatctccagagacaattccaagaatatactgtatcttcaaatgggcagactgagacctgaggacatggctgtgtattactgtgcgagagagggacaactttggtactttgactactggggccagggaaccacggtcaccgtctcctca

SEQ ID NO: 3050 - protein, 118 aa, Artificial Sequence
  synthetic
EVQLVESGGGLVQPGGSLRLSCAASGFTFSSYDMHWVRQAPGKGLEYVSGISSKGGSTYYADSVKGRFTISRDNSKNILYLQMGRLRPEDMAVYYCAREGQLWYFDYWGQGTTVTVSS

SEQ ID NO: 3051 - DNA, 24 bp, Artificial Sequence
  synthetic
ggattcaccttcagtagctatgat

SEQ ID NO: 3052 - protein, 8 aa, Artificial Sequence
  synthetic
GFTFSSYD

SEQ ID NO: 3053 - DNA, 24 bp, Artificial Sequence
  synthetic
attagtagtaaggggggtagcaca

SEQ ID NO: 3054 - protein, 8 aa, Artificial Sequence
  synthetic
ISSKGGST

SEQ ID NO: 3055 - DNA, 33 bp, Artificial Sequence; identical to SEQ ID NO: 2927
  synthetic

SEQ ID NO: 3056 - protein, 11 aa, Artificial Sequence
  synthetic
AREGQLWYFDY

SEQ ID NO: 3057 - DNA, 324 bp, Artificial Sequence; identical to SEQ ID NO: 2929
  synthetic

SEQ ID NO: 3058 - protein, 108 aa, Artificial Sequence; identical to SEQ ID NO: 2930
  synthetic

SEQ ID NO: 3059 - DNA, 18 bp, Artificial Sequence
  synthetic
cagagtgttagtagctac

SEQ ID NO: 3060 - protein, 6 aa, Artificial Sequence
  synthetic
QSVSSY

SEQ ID NO: 3061 - DNA, 9 bp, Artificial Sequence
  synthetic
gctgcatcc

SEQ ID NO: 3062 - protein, 3 aa, Artificial Sequence
  synthetic
AAS

SEQ ID NO: 3063 - DNA, 27 bp, Artificial Sequence
  synthetic
cagcagcgttccaactggcctctcact

SEQ ID NO: 3064 - protein, 9 aa, Artificial Sequence
  synthetic
QQRSNWPLT

SEQ ID NO: 3065 - DNA, 354 bp, Artificial Sequence
  synthetic
caggtgcagctggtggagtctgggggaggcttggtccagcctggggggtccctgagactctcctgtgcagcctctggattcatcttcagtagctatgatatgcactgggtccgccaggctccagggaagggactggaatatgtttcaggtattagtactaaggggggaagtacatattatgcagactctgtgaaggacagattcaccatctccagagacaattccaagaacacgctatatcttcaaatgggcagcctgagagctgaggacatggctgtatattactgtgcgagagagggacaactttggtactttgactactggggccagggaaccacggtcaccgtctcctca

SEQ ID NO: 3066 - protein, 118 aa, Artificial Sequence
  synthetic
QVQLVESGGGLVQPGGSLRLSCAASGFIFSSYDMHWVRQAPGKGLEYVSGISTKGGSTYYADSVKDRFTISRDNSKNTLYLQMGSLRAEDMAVYYCAREGQLWYFDYWGQGTTVTVSS

SEQ ID NO: 3067 - DNA, 24 bp, Artificial Sequence
  synthetic
ggattcatcttcagtagctatgat

SEQ ID NO: 3068 - protein, 8 aa, Artificial Sequence
  synthetic
GFIFSSYD

SEQ ID NO: 3069 - DNA, 24 bp, Artificial Sequence
  synthetic
attagtactaaggggggaagtaca

SEQ ID NO: 3070 - protein, 8 aa, Artificial Sequence
  synthetic
ISTKGGST

SEQ ID NO: 3071 - DNA, 33 bp, Artificial Sequence; identical to SEQ ID NO: 2927
  synthetic

SEQ ID NO: 3072 - protein, 11 aa, Artificial Sequence
  synthetic
AREGQLWYFDY

SEQ ID NO: 3073 - DNA, 324 bp, Artificial Sequence
  synthetic
gacatcgtgatgacccagtctccagccaccctgtctttgtctccaggggaaagagccaccctctcctgcagggccagtcagactgttagaagctacttagcctggtaccaacagaaacctggccaggctcccagactcctcatctatactgcatctaacagggccactggcatcccagccaggttcagtggcagtgggtctgggacagacttcatcctcaccatcagcagcctagagcctgaagattttgcagtttattactgtcagcagcgttccaactggcctctcactttcggccctgggaccaaggtggagatcaaacga

SEQ ID NO: 3074 - protein, 108 aa, Artificial Sequence
  synthetic
DIVMTQSPATLSLSPGERATLSCRASQTVRSYLAWYQQKPGQAPRLLIYTASNRATGIPARFSGSGSGTDFILTISSLEPEDFAVYYCQQRSNWPLTFGPGTKVEIKR

SEQ ID NO: 3075 - DNA, 18 bp, Artificial Sequence
  synthetic
cagactgttagaagctac

SEQ ID NO: 3076 - protein, 6 aa, Artificial Sequence
  synthetic
QTVRSY

SEQ ID NO: 3077 - DNA, 9 bp, Artificial Sequence
  synthetic
actgcatct

SEQ ID NO: 3078 - protein, 3 aa, Artificial Sequence
  synthetic
TAS

SEQ ID NO: 3079 - DNA, 27 bp, Artificial Sequence
  synthetic
cagcagcgttccaactggcctctcact

SEQ ID NO: 3080 - protein, 9 aa, Artificial Sequence
  synthetic
QQRSNWPLT

SEQ ID NO: 3081 - DNA, 354 bp, Artificial Sequence
  synthetic
caggtgcagctggtggagtctgggggaggcgtggtccagcctgggaggtccctgagactctcctgtgcagcgtctggattcaccttcagtacctatggcatgcattgggtccgccaggctccaggcaaggggctggagtgggtggcccttatatggtatgacggaagtaataaaaactatgcagattccgtgacgggccgattcaccatctccagagacaattccaagaacacattgtatctgcaaatgaacagcctgagagccgaggacacggctgtgtattactgtgcgacagaaatagcagctcgtccctttgaatactggggccagggaaccctggtcaccgtctcctca

SEQ ID NO: 3082 - protein, 118 aa, Artificial Sequence
  synthetic
QVQLVESGGGVVQPGRSLRLSCAASGFTFSTYGMHWVRQAPGKGLEWVALIWYDGSNKNYADSVTGRFTISRDNSKNTLYLQMNSLRAEDTAVYYCATEIAARPFEYWGQGTLVTVSS

SEQ ID NO: 3083 - DNA, 24 bp, Artificial Sequence
  synthetic
ggattcaccttcagtacctatggc

SEQ ID NO: 3084 - protein, 8 aa, Artificial Sequence
  synthetic
GFTFSTYG

SEQ ID NO: 3085 - DNA, 24 bp, Artificial Sequence
  synthetic
atatggtatgacggaagtaataaa

SEQ ID NO: 3086 - protein, 8 aa, Artificial Sequence
  synthetic
IWYDGSNK

SEQ ID NO: 3087 - DNA, 33 bp, Artificial Sequence; identical to SEQ ID NO: 2895
  synthetic

SEQ ID NO: 3088 - protein, 11 aa, Artificial Sequence
  synthetic
ATEIAARPFEY

SEQ ID NO: 3089 - DNA, 339 bp, Artificial Sequence
  synthetic
gacatcgtgatgacccagtctccactctccctgcccgtcactcctggagagccggcctccatctcctgcaggtctactcagagtctcctacaaattaatggatacaactatttggattggtacctgcagaagccagggcagtctccacagctcctgatctatttgggttctaatcgggcctccggggtccctgacaggttcagtggcagtggagcaggcacagattttacactaaagatcagcagagtggaggctgaggatgttggggtttattactgcatgcaagctcttcaaactccgtacacttttggccaggggaccaaggtggagatcaaacga

SEQ ID NO: 3090 - protein, 113 aa, Artificial Sequence; identical to SEQ ID NO: 2898
  synthetic

SEQ ID NO: 3091 - DNA, 33 bp, Artificial Sequence; identical to SEQ ID NO: 2963
  synthetic

SEQ ID NO: 3092 - protein, 11 aa, Artificial Sequence
  synthetic
QSLLQINGYNY

SEQ ID NO: 3093 - DNA, 9 bp, Artificial Sequence
  synthetic
ttgggttct

SEQ ID NO: 3094 - protein, 3 aa, Artificial Sequence
  synthetic
LGS

SEQ ID NO: 3095 - DNA, 27 bp, Artificial Sequence
  synthetic
atgcaagctcttcaaactccgtacact

SEQ ID NO: 3096 - protein, 9 aa, Artificial Sequence
  synthetic
MQALQTPYT

SEQ ID NO: 3097 - DNA, 363 bp, Artificial Sequence
  synthetic
caggtgcagctggtggagtctgaaacagaggtgaaaaagcccggggagtctctgaagatctcctgtaagggttctggatacagctttaccaactactggatcggctgggtgcgccagatgcccggaaaaggcctggagtggatggggatcatctatcctggtgactctgataccagaaacagcccgtccttccaaggccaggtcaccatctcagccgacaagaccatcagcaccgcctacctgcagtggagcagcctgaaggcctcggacaccgccatgtattactgtgcgaggtcggcagatttttggagtggttatccctttgactactggggccagggaaccctggtcaccgtctcctca

SEQ ID NO: 3098 - protein, 121 aa, Artificial Sequence
  synthetic
QVQLVESETEVKKPGESLKISCKGSGYSFTNYWIGWVRQMPGKGLEWMGIIYPGDSDTRNSPSFQGQVTISADKTISTAYLQWSSLKASDTAMYYCARSADFWSGYPFDYWGQGTLVTVSS

SEQ ID NO: 3099 - DNA, 24 bp, Artificial Sequence
  synthetic
ggatacagctttaccaactactgg

SEQ ID NO: 3100 - protein, 8 aa, Artificial Sequence
  synthetic
GYSFTNYW

SEQ ID NO: 3101 - DNA, 24 bp, Artificial Sequence
  synthetic
atctatcctggtgactctgatacc

SEQ ID NO: 3102 - protein, 8 aa, Artificial Sequence
  synthetic
IYPGDSDT

SEQ ID NO: 3103 - DNA, 42 bp, Artificial Sequence
  synthetic
gcgaggtcggcagatttttggagtggttatccctttgactac

SEQ ID NO: 3104 - protein, 14 aa, Artificial Sequence
  synthetic
ARSADFWSGYPFDY

SEQ ID NO: 3105 - DNA, 324 bp, Artificial Sequence
  synthetic
gacatcgtgatgacccagtctccatcctccctgtctgcatctgtaggagacagactcaccatcacttgccgggcaagtcagagcattagcagctatttaaattggtatcagcagaaaccagggaaagcccctaacctcctgatctatgctgcatccagtttgcaaagtggggtcccatcaaggttcagtggcagtggatctgggacagatttcactctcaacatcagcagtctgcaacctgaagatttttcaacttactattgtcaacagacctacagtatcccgtacacttttggccaggggaccaaggtggagatcaaacga

SEQ ID NO: 3106 - protein, 108 aa, Artificial Sequence
  synthetic
DIVMTQSPSSLSASVGDRLTITCRASQSISSYLNWYQQKPGKAPNLLIYAASSLQSGVPSRFSGSGSGTDFTLNISSLQPEDFSTYYCQQTYSIPYTFGQGTKVEIKR

SEQ ID NO: 3107 - DNA, 18 bp, Artificial Sequence
  synthetic
cagagcattagcagctat

SEQ ID NO: 3108 - protein, 6 aa, Artificial Sequence
  synthetic
QSISSY

SEQ ID NO: 3109 - DNA, 9 bp, Artificial Sequence
  synthetic
gctgcatcc

SEQ ID NO: 3110 - protein, 3 aa, Artificial Sequence
  synthetic
AAS

SEQ ID NO: 3111 - DNA, 27 bp, Artificial Sequence
  synthetic
caacagacctacagtatcccgtacact

SEQ ID NO: 3112 - protein, 9 aa, Artificial Sequence
  synthetic
QQTYSIPYT

SEQ ID NO: 3113 - DNA, 354 bp, Artificial Sequence
  synthetic
gaggtgcagctggtggagtctgggggaggcgtggtccagcctggggggtccctgagactctcctgtgcagcgtctggattcaccttcagttcctatggcatgcattgggtccgccaggctccaggcaagggactggagtgggtggcccttatatggtatgacggaagtaataaaaactatgcagattccgtgatgggccgattcaccatctccagagacaattccaggagcacattgtttctgcaaatgaacagcctgagagccgaggacacggctctttattactgtgcgacagaaatagcatctcgtccctttgaatactggggccagggaaccctggtcaccgtctcctca

SEQ ID NO: 3114 - protein, 118 aa, Artificial Sequence
  synthetic
EVQLVESGGGVVQPGGSLRLSCAASGFTFSSYGMHWVRQAPGKGLEWVALIWYDGSNKNYADSVMGRFTISRDNSRSTLFLQMNSLRAEDTALYYCATEIASRPFEYWGQGTLVTVSS

SEQ ID NO: 3115 - DNA, 24 bp, Artificial Sequence
  synthetic
ggattcaccttcagttcctatggc

SEQ ID NO: 3116 - protein, 8 aa, Artificial Sequence
  synthetic
GFTFSSYG

SEQ ID NO: 3117 - DNA, 24 bp, Artificial Sequence
  synthetic
atatggtatgacggaagtaataaa

SEQ ID NO: 3118 - protein, 8 aa, Artificial Sequence
  synthetic
IWYDGSNK

SEQ ID NO: 3119 - DNA, 33 bp, Artificial Sequence
  synthetic
gcgacagaaatagcatctcgtccctttgaatac

SEQ ID NO: 3120 - protein, 11 aa, Artificial Sequence
  synthetic
ATEIASRPFEY

SEQ ID NO: 3121 - DNA, 339 bp, Artificial Sequence
  synthetic
gacatcgtgatgacccagtctccactctccctgcccgtcactcctggagagccggcctccatctcctgcaggtcttctcagagcctcctacagattaatggatacaactatttggattggtacctgcagaagccagggcagtctccacagctcctgatctatttgggttctaatcgggcctccggggtccctgacaggttcagtggcagtggagcaggcacagattttacactgaagatcagcagagtggaggctgaggatattgggatttattactgcatgcaagctcttcaaactccgtacacttttggccaggggaccaaggtggagatcaaacga

SEQ ID NO: 3122 - protein, 113 aa, Artificial Sequence
  synthetic
DIVMTQSPLSLPVTPGEPASISCRSSQSLLQINGYNYLDWYLQKPGQSPQLLIYLGSNRASGVPDRFSGSGAGTDFTLKISRVEAEDIGIYYCMQALQTPYTFGQGTKVEIKR

SEQ ID NO: 3123 - DNA, 33 bp, Artificial Sequence; identical to SEQ ID NO: 2899
  synthetic

SEQ ID NO: 3124 - protein, 11 aa, Artificial Sequence
  synthetic
QSLLQINGYNY

SEQ ID NO: 3125 - DNA, 9 bp, Artificial Sequence
  synthetic
ttgggttct

SEQ ID NO: 3126 - protein, 3 aa, Artificial Sequence
  synthetic
LGS

SEQ ID NO: 3127 - DNA, 27 bp, Artificial Sequence
  synthetic
atgcaagctcttcaaactccgtacact

SEQ ID NO: 3128 - protein, 9 aa, Artificial Sequence
  synthetic
MQALQTPYT

SEQ ID NO: 3129 - DNA, 363 bp, Artificial Sequence
  synthetic
caggtgcagctggtgcagtggggcgcaggactgttgaagccttcggagaccctgtccctcacctgcgttgtctatggtgggtccttaagtggttactactggagcttgatccgccagtccccagggaaggggctggagtggattggggaaatcgatcatactggaagcaccaactacaacccgtccctcaagagtcgagtcaccatatcagtggacacgtccaagaaccagttctccctgaagctgagctctgtgaccgccgcggacacggctttgtattactgtgcgagaggctctcttataacagatcgagactggtatttcgatatctggggccgtggcaccctggtcaccgtctcctca

SEQ ID NO: 3130 - protein, 121 aa, Artificial Sequence
  synthetic
QVQLVQWGAGLLKPSETLSLTCVVYGGSLSGYYWSLIRQSPGKGLEWIGEIDHTGSTNYNPSLKSRVTISVDTSKNQFSLKLSSVTAADTALYYCARGSLITDRDWYFDIWGRGTLVTVSS

SEQ ID NO: 3131 - DNA, 24 bp, Artificial Sequence
  synthetic
ggtgggtccttaagtggttactac

SEQ ID NO: 3132 - protein, 8 aa, Artificial Sequence
  synthetic
GGSLSGYY

SEQ ID NO: 3133 - DNA, 21 bp, Artificial Sequence
  synthetic
atcgatcatactggaagcacc

SEQ ID NO: 3134 - protein, 7 aa, Artificial Sequence
  synthetic
IDHTGST

SEQ ID NO: 3135 - DNA, 45 bp, Artificial Sequence
  synthetic
gcgagaggctctcttataacagatcgagactggtatttcgatatc

SEQ ID NO: 3136 - protein, 15 aa, Artificial Sequence
  synthetic
ARGSLITDRDWYFDI

SEQ ID NO: 3137 - DNA, 324 bp, Artificial Sequence
  synthetic
gacatcgtgatgacccagtctccagccaccctgtctgtgtctccaggggaaagagtcaccctctcctgcagggccagtcagagtgttaccagcaacttagcctggtaccagcagaaacctgcccaggctcccaggctcctcatctatgctgcatccaccagggccactggtatcccagccaggttcagtggcagtgggtctgggacagaatacactctcaccatcagcagcctgcagtctgaagattttgcagtttattactgtcaacactataataactggccgtacacttttggccaggggaccaaggtggagatcaaacga

SEQ ID NO: 3138 - protein, 108 aa, Artificial Sequence
  synthetic
DIVMTQSPATLSVSPGERVTLSCRASQSVTSNLAWYQQKPAQAPRLLIYAASTRATGIPARFSGSGSGTEYTLTISSLQSEDFAVYYCQHYNNWPYTFGQGTKVEIKR

SEQ ID NO: 3139 - DNA, 18 bp, Artificial Sequence
  synthetic
cagagtgttaccagcaac

SEQ ID NO: 3140 - protein, 6 aa, Artificial Sequence
  synthetic
QSVTSN

SEQ ID NO: 3141 - DNA, 9 bp, Artificial Sequence
  synthetic
gctgcatcc

SEQ ID NO: 3142 - protein, 3 aa, Artificial Sequence
  synthetic
AAS

SEQ ID NO: 3143 - DNA, 27 bp, Artificial Sequence
  synthetic
caacactataataactggccgtacact

SEQ ID NO: 3144 - protein, 9 aa, Artificial Sequence
  synthetic
QHYNNWPYT

SEQ ID NO: 3145 - DNA, 366 bp, Artificial Sequence
  synthetic
gaggtgcagctggtggagtctgggggaggcttggtacagcctggggggtccctgagactctcctgtgcagcctctggattcacctttagcagctataccatgagctgggtccgccaggctccagggaaggggctggagtgggtctcaactattatttttagtggtcttttcacatactacgcggactccgtgaagggccgtttcaccatctccagagacaattccaagaacaccctctttctgcaaatgaatagcctgggggccgaggacacggccatatattactgtgcgaaagcctcagctacaataactacgaaggacggtatggacgtctggggccaagggaccacggtcaccgtctcctca

SEQ ID NO: 3146 - protein, 122 aa, Artificial Sequence
  synthetic
EVQLVESGGGLVQPGGSLRLSCAASGFTFSSYTMSWVRQAPGKGLEWVSTIIFSGLFTYYADSVKGRFTISRDNSKNTLFLQMNSLGAEDTAIYYCAKASATITTKDGMDVWGQGTTVTVSS

SEQ ID NO: 3147 - DNA, 24 bp, Artificial Sequence
  synthetic
ggattcacctttagcagctatacc

SEQ ID NO: 3148 - protein, 8 aa, Artificial Sequence
  synthetic
GFTFSSYT

SEQ ID NO: 3149 - DNA, 24 bp, Artificial Sequence
  synthetic
attatttttagtggtcttttcaca

SEQ ID NO: 3150 - protein, 8 aa, Artificial Sequence
  synthetic
IIFSGLFT

SEQ ID NO: 3151 - DNA, 45 bp, Artificial Sequence
  synthetic
gcgaaagcctcagctacaataactacgaaggacggtatggacgtc

SEQ ID NO: 3152 - protein, 15 aa, Artificial Sequence
  synthetic
AKASATITTKDGMDV

SEQ ID NO: 3153 - DNA, 324 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagttcctgatctctgctgcatccagtttacaaagtggggtcccttcaaggttcagcggcagtggatctgacacagatttcactctcaccatcagcagcctgcagactgaagattttgcaacttattactgtctacaagatttcaatttccctcggacattcggccaagggaccaaggtggagatcaaacga

SEQ ID NO: 3154 - protein, 108 aa, Artificial Sequence
  synthetic
DIQMTQSPSSLSASVGDRVTITCRASQGIRNDLGWYQQKPGKAPKFLISAASSLQSGVPSRFSGSGSDTDFTLTISSLQTEDFATYYCLQDFNFPRTFGQGTKVEIKR

SEQ ID NO: 3155 - DNA, 18 bp, Artificial Sequence
  synthetic
cagggcattagaaatgat

SEQ ID NO: 3156 - protein, 6 aa, Artificial Sequence
  synthetic
QGIRND

SEQ ID NO: 3157 - DNA, 9 bp, Artificial Sequence
  synthetic
gctgcatcc

SEQ ID NO: 3158 - protein, 3 aa, Artificial Sequence
  synthetic
AAS

SEQ ID NO: 3159 - DNA, 27 bp, Artificial Sequence
  synthetic
ctacaagatttcaatttccctcggaca

SEQ ID NO: 3160 - protein, 9 aa, Artificial Sequence
  synthetic
LQDFNFPRT

SEQ ID NO: 3161 - DNA, 363 bp, Artificial Sequence
  synthetic
caggtgcagctggtgcagtggggcgcaggactgttgaagccttcggagaccctgtccctcacctgcgctgtctatggtgggtccctcagtggttactattggagctggatccgccagcccccagggaaggggctggcgtggattggggagatcgatcatactggaagcaccaactacaacccgtccctcaagagtcgagtcaccatatcagtagacacgtccaagaaccagttctccctgaggctgagttctgtgaccgccgcggacacggctgtgtattactgtgcgagaggctctcgtataacagatcgagactggtacttcgatctctggggccgtggcaccctggtcaccgtctcctca

SEQ ID NO: 3162 - protein, 121 aa, Artificial Sequence
  synthetic
QVQLVQWGAGLLKPSETLSLTCAVYGGSLSGYYWSWIRQPPGKGLAWIGEIDHTGSTNYNPSLKSRVTISVDTSKNQFSLRLSSVTAADTAVYYCARGSRITDRDWYFDLWGRGTLVTVSS

SEQ ID NO: 3163 - DNA, 24 bp, Artificial Sequence
  synthetic
ggtgggtccctcagtggttactat

SEQ ID NO: 3164 - protein, 8 aa, Artificial Sequence
  synthetic
GGSLSGYY

SEQ ID NO: 3165 - DNA, 21 bp, Artificial Sequence
  synthetic
atcgatcatactggaagcacc

SEQ ID NO: 3166 - protein, 7 aa, Artificial Sequence
  synthetic
IDHTGST

SEQ ID NO: 3167 - DNA, 45 bp, Artificial Sequence
  synthetic
gcgagaggctctcgtataacagatcgagactggtacttcgatctc

SEQ ID NO: 3168 - protein, 15 aa, Artificial Sequence
  synthetic
ARGSRITDRDWYFDL

SEQ ID NO: 3169 - DNA, 324 bp, Artificial Sequence
  synthetic
gacatcgtgatgacccagtctccagccaccctgtctgtgtctccaggggaaagagccaccctctcctgtagggccagtcagagtgttagtagccacttagcctggtaccaccagaaacctggccaggctcccaggctcctcctctattctggatccaccagggccactggtatcccagccaggttcagtggcagtgggtctgggacagagttcgctctcaccatcagcagcctgcagtctgaagattttgcagtttattactgtcagcaatataatgactggccgtacacttttggccaggggaccaaggtggagatcaaacga

SEQ ID NO: 3170 - protein, 108 aa, Artificial Sequence
  synthetic
DIVMTQSPATLSVSPGERATLSCRASQSVSSHLAWYHQKPGQAPRLLLYSGSTRATGIPARFSGSGSGTEFALTISSLQSEDFAVYYCQQYNDWPYTFGQGTKVEIKR

SEQ ID NO: 3171 - DNA, 18 bp, Artificial Sequence
  synthetic
cagagtgttagtagccac

SEQ ID NO: 3172 - protein, 6 aa, Artificial Sequence
  synthetic
QSVSSH

SEQ ID NO: 3173 - DNA, 9 bp, Artificial Sequence
  synthetic
tctggatcc

SEQ ID NO: 3174 - protein, 3 aa, Artificial Sequence
  synthetic
SGS

SEQ ID NO: 3175 - DNA, 27 bp, Artificial Sequence
  synthetic
cagcaatataatgactggccgtacact

SEQ ID NO: 3176 - protein, 9 aa, Artificial Sequence
  synthetic
QQYNDWPYT

SEQ ID NO: 3177 - DNA, 348 bp, Artificial Sequence
  synthetic
caggtgcagctggtggagtctgggggaggcttggtacagccagggcggtccctgagactctcctgtacagtttctggactcacctttggtgattatgctatgacctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaagaccgaggacacagccgtgtattactgtagttcgtccggacctgactactggggccagggaaccctggtcaccgtctcctca

SEQ ID NO: 3178 - protein, 116 aa, Artificial Sequence
  synthetic
QVQLVESGGGLVQPGRSLRLSCTVSGLTFGDYAMTWVRQAPGKGLEWVGFIRSKAYGGTTEYAASVKGRFTISRDDSKSIAYLQMNSLKTEDTAVYYCSSSGPDYWGQGTLVTVSS

SEQ ID NO: 3179 - DNA, 24 bp, Artificial Sequence
  synthetic
ggactcacctttggtgattatgct

SEQ ID NO: 3180 - protein, 8 aa, Artificial Sequence
  synthetic
GLTFGDYA

SEQ ID NO: 3181 - DNA, 30 bp, Artificial Sequence
  synthetic
attagaagcaaagcttatggtgggacaaca

SEQ ID NO: 3182 - protein, 10 aa, Artificial Sequence
  synthetic
IRSKAYGGTT

SEQ ID NO: 3183 - DNA, 21 bp, Artificial Sequence
  synthetic
agttcgtccggacctgactac

SEQ ID NO: 3184 - protein, 7 aa, Artificial Sequence
  synthetic
SSSGPDY

SEQ ID NO: 3185 - DNA, 324 bp, Artificial Sequence
  synthetic
gacatcctgatgacccagtctccatcctccctgtctgcatctgtaggagacagagtcaccatcacttgccgggcaagtcagggcattagaaatgatttagtctggtatcagcagaaaccagggaaagcccctaagcgcctgatctatgctgcatccggtttgcaaagtggggtcccatcgaggttcagcggcagtggatctgggacagaattcactctcacaatcagcagcctgcagcctgaagattttgcaacttattactgtctacaacataatagttacccgtggacgttcggccaagggaccaaggtggagatcaaacga

SEQ ID NO: 3186 - protein, 108 aa, Artificial Sequence
  synthetic
DILMTQSPSSLSASVGDRVTITCRASQGIRNDLVWYQQKPGKAPKRLIYAASGLQSGVPSRFSGSGSGTEFTLTISSLQPEDFATYYCLQHNSYPWTFGQGTKVEIKR

SEQ ID NO: 3187 - DNA, 18 bp, Artificial Sequence
  synthetic
cagggcattagaaatgat

SEQ ID NO: 3188 - protein, 6 aa, Artificial Sequence
  synthetic
QGIRND

SEQ ID NO: 3189 - DNA, 9 bp, Artificial Sequence
  synthetic
gctgcatcc

SEQ ID NO: 3190 - protein, 3 aa, Artificial Sequence
  synthetic
AAS

SEQ ID NO: 3191 - DNA, 27 bp, Artificial Sequence
  synthetic
ctacaacataatagttacccgtggacg

SEQ ID NO: 3192 - protein, 9 aa, Artificial Sequence
  synthetic
LQHNSYPWT

SEQ ID NO: 3193 - DNA, 363 bp, Artificial Sequence
  synthetic
caggtgcagctggtgcagtggggcgcaggactgttgaagccttcggagaccctgtccctcacctgcgctgtctctggtgggaccctcagtccttactattggagctggatccgccagcccccagggaaggggctggagtggattggggaaatcgatcatactggaagtaccaacttcaatccgtccctcaagagtcgagtcaccatatcagtagacacgtccaagaaccagttctccctgaatctgaactctgtgaccgccgcggacacggctatctatttctgtgcgagaggctctcttataacatctcgagactggtacttcgatctctggggccgtggcaccctggtcaccgtctcctca

SEQ ID NO: 3194 - protein, 121 aa, Artificial Sequence
  synthetic
QVQLVQWGAGLLKPSETLSLTCAVSGGTLSPYYWSWIRQPPGKGLEWIGEIDHTGSTNFNPSLKSRVTISVDTSKNQFSLNLNSVTAADTAIYFCARGSLITSRDWYFDLWGRGTLVTVSS

SEQ ID NO: 3195 - DNA, 24 bp, Artificial Sequence
  synthetic
ggtgggaccctcagtccttactat

SEQ ID NO: 3196 - protein, 8 aa, Artificial Sequence
  synthetic
GGTLSPYY

SEQ ID NO: 3197 - DNA, 21 bp, Artificial Sequence
  synthetic
atcgatcatactggaagtacc

SEQ ID NO: 3198 - protein, 7 aa, Artificial Sequence
  synthetic
IDHTGST

SEQ ID NO: 3199 - DNA, 45 bp, Artificial Sequence
  synthetic
gcgagaggctctcttataacatctcgagactggtacttcgatctc

SEQ ID NO: 3200 - protein, 15 aa, Artificial Sequence
  synthetic
ARGSLITSRDWYFDL

SEQ ID NO: 3201 - DNA, 324 bp, Artificial Sequence
  synthetic
gacatcgtgatgacccagtctccagccaccctgtctgtgtctccaggggaaagaggcaccctctcctgcagggccagtcagagtcttagcagccacttagcctggtaccagcagaaacctggccaggctcccaggctcctcatctatggtgcttccgccagggccactggcatcccagccaggttcagtggcagtgggtctgggacagacttcactctcaccatcagcagcctgcagtctgaagattttgcagtttattactgtcagcagtatgataactggccgtacacttttggccaggggaccaaggtggagatcaaacga

SEQ ID NO: 3202 - protein, 108 aa, Artificial Sequence
  synthetic
DIVMTQSPATLSVSPGERGTLSCRASQSLSSHLAWYQQKPGQAPRLLIYGASARATGIPARFSGSGSGTDFTLTISSLQSEDFAVYYCQQYDNWPYTFGQGTKVEIKR

SEQ ID NO: 3203 - DNA, 18 bp, Artificial Sequence
  synthetic
cagagtcttagcagccac

SEQ ID NO: 3204 - protein, 6 aa, Artificial Sequence
  synthetic
QSLSSH

SEQ ID NO: 3205 - DNA, 9 bp, Artificial Sequence
  synthetic
ggtgcttcc

SEQ ID NO: 3206 - protein, 3 aa, Artificial Sequence
  synthetic
GAS

SEQ ID NO: 3207 - DNA, 27 bp, Artificial Sequence
  synthetic
cagcagtatgataactggccgtacact

SEQ ID NO: 3208 - protein, 9 aa, Artificial Sequence
  synthetic
QQYDNWPYT

SEQ ID NO: 3209 - DNA, 360 bp, Artificial Sequence
  synthetic
caggtgcagctggtgcagtggggcgcaggactgttgaagccttcggagaccctgtccctcacctgcgctgtctatggtgggtccttccgtggttactactggaactggatccgccagcccccggggaaggggctggagtggattggggaaatcaatcatagtggaagcaccacctacaacccgtccctcaagagtcgattcaccatgtcagtggacacgtccaagaaccagttctccctgattctgagctctgtgaccgccgcggacacggctgtgtattactgtgcgagaaatgagctaactggagattgggttgcttttgatatctggggccaagggacaatggtcaccgtctcctca

SEQ ID NO: 3210 - protein, 120 aa, Artificial Sequence
  synthetic
QVQLVQWGAGLLKPSETLSLTCAVYGGSFRGYYWNWIRQPPGKGLEWIGEINHSGSTTYNPSLKSRFTMSVDTSKNQFSLILSSVTAADTAVYYCARNELTGDWVAFDIWGQGTMVTVSS

SEQ ID NO: 3211 - DNA, 24 bp, Artificial Sequence
  synthetic
ggtgggtccttccgtggttactac

SEQ ID NO: 3212 - protein, 8 aa, Artificial Sequence
  synthetic
GGSFRGYY

SEQ ID NO: 3213 - DNA, 21 bp, Artificial Sequence
  synthetic
atcaatcatagtggaagcacc

SEQ ID NO: 3214 - protein, 7 aa, Artificial Sequence
  synthetic
INHSGST

SEQ ID NO: 3215 - DNA, 42 bp, Artificial Sequence
  synthetic
gcgagaaatgagctaactggagattgggttgcttttgatatc

SEQ ID NO: 3216 - protein, 14 aa, Artificial Sequence
  synthetic
ARNELTGDWVAFDI

SEQ ID NO: 3217 - DNA, 327 bp, Artificial Sequence
  synthetic
gacatcgtgatgacccagtctccaggcaccctgtctttgtctccaggggagagagccaccctctcctgcagggccagtcagagtgttagcgccagctacttagcctggtaccagcagaaacctggccaggctcccaggctcctcatctttggtgcatccagcagggccactggcatcccagacaggttcagtggcagtgggtctgggacagacttcactctcaccatcagcagactggagcctgaagattttgcagtgtatttctgtcagcagtatggtagctcaccgtggacgttcggccaagggaccaaggtggagatcaaacga

SEQ ID NO: 3218 - protein, 109 aa, Artificial Sequence
  synthetic
DIVMTQSPGTLSLSPGERATLSCRASQSVSASYLAWYQQKPGQAPRLLIFGASSRATGIPDRFSGSGSGTDFTLTISRLEPEDFAVYFCQQYGSSPWTFGQGTKVEIKR

SEQ ID NO: 3219 - DNA, 21 bp, Artificial Sequence
  synthetic
cagagtgttagcgccagctac

SEQ ID NO: 3220 - protein, 7 aa, Artificial Sequence
  synthetic
QSVSASY

SEQ ID NO: 3221 - DNA, 9 bp, Artificial Sequence
  synthetic
ggtgcatcc

SEQ ID NO: 3222 - protein, 3 aa, Artificial Sequence
  synthetic
GAS

SEQ ID NO: 3223 - DNA, 27 bp, Artificial Sequence
  synthetic
cagcagtatggtagctcaccgtggacg

SEQ ID NO: 3224 - protein, 9 aa, Artificial Sequence
  synthetic
QQYGSSPWT

SEQ ID NO: 3225 - DNA, 360 bp, Artificial Sequence
  synthetic
caggtgcagctggtgcagtggggcgcaggactgttgatgccttcggagaccctgtccctcacctgcgctgtctatggtgggtccttcagtggttactactggagctgggtccgccagcccccagggaaggggctggagtggattggggaaatcgatcatagtggaagcaccaactacaacccgtccctcaagagtcgagtcaccatatcagtagacacgtccaagaaccagttctccctgaagctgagctctgtgaccgccgcggacacggctgtgtattactgtgcgagaagggagctaactggggattggggtgcttttgatatctggggccaagggacaatggtcaccgtctcctca

SEQ ID NO: 3226 - protein, 120 aa, Artificial Sequence
  synthetic
QVQLVQWGAGLLMPSETLSLTCAVYGGSFSGYYWSWVRQPPGKGLEWIGEIDHSGSTNYNPSLKSRVTISVDTSKNQFSLKLSSVTAADTAVYYCARRELTGDWGAFDIWGQGTMVTVSS

SEQ ID NO: 3227 - DNA, 24 bp, Artificial Sequence
  synthetic
ggtgggtccttcagtggttactac

SEQ ID NO: 3228 - protein, 8 aa, Artificial Sequence
  synthetic
GGSFSGYY

SEQ ID NO: 3229 - DNA, 21 bp, Artificial Sequence
  synthetic
atcgatcatagtggaagcacc

SEQ ID NO: 3230 - protein, 7 aa, Artificial Sequence
  synthetic
IDHSGST

SEQ ID NO: 3231 - DNA, 42 bp, Artificial Sequence
  synthetic
gcgagaagggagctaactggggattggggtgcttttgatatc

SEQ ID NO: 3232 - protein, 14 aa, Artificial Sequence
  synthetic
ARRELTGDWGAFDI

SEQ ID NO: 3233 - DNA, 327 bp, Artificial Sequence
  synthetic
gacatcgtgatgacccagtctccaggcaccctgtctttgtctccaggggaaagagccaccctctcctgcagggccagtcagagtgttagcggcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggagatcaaacga

SEQ ID NO: 3234 - protein, 109 aa, Artificial Sequence
  synthetic
DIVMTQSPGTLSLSPGERATLSCRASQSVSGSYLAWYQQKPGQAPRLLIYGASSRATGIPDRFSGSGSGTDFTLTISRLEPEDFAVYYCQQYGSSPWTFGQGTKVEIKR

SEQ ID NO: 3235 - DNA, 21 bp, Artificial Sequence
  synthetic
cagagtgttagcggcagctac

SEQ ID NO: 3236 - protein, 7 aa, Artificial Sequence
  synthetic
QSVSGSY

SEQ ID NO: 3237 - DNA, 9 bp, Artificial Sequence
  synthetic
ggtgcatcc

SEQ ID NO: 3238 - protein, 3 aa, Artificial Sequence
  synthetic
GAS

SEQ ID NO: 3239 - DNA, 27 bp, Artificial Sequence
  synthetic
cagcagtatggtagctcaccgtggacg

SEQ ID NO: 3240 - protein, 9 aa, Artificial Sequence
  synthetic
QQYGSSPWT

SEQ ID NO: 3241 - DNA, 366 bp, Artificial Sequence
  synthetic
gaggtgcagctggtggagtctgggggaggcttggtactgcctggggggtccctgagactctcctgtgcagcctctggattcacctttaacagttacgccttgacctgggtccgccaggctccagggagggggctggaatgggtctcaactattattttcagtggtggtatcatatggtacgcagactccgtgaagggccggttcaccatctccagagacaattccaagaacacgctgtatctgcaaatgaacaccatgagagccgaggacacggccatatattactgtgcgaaagcctcagccactataacgacaaaggacggtttggacgtctggggccaagggaccacggtcaccgtctcctca

SEQ ID NO: 3242 - protein, 122 aa, Artificial Sequence
  synthetic
EVQLVESGGGLVLPGGSLRLSCAASGFTFNSYALTWVRQAPGRGLEWVSTIIFSGGIIWYADSVKGRFTISRDNSKNTLYLQMNTMRAEDTAIYYCAKASATITTKDGLDVWGQGTTVTVSS

SEQ ID NO: 3243 - DNA, 24 bp, Artificial Sequence
  synthetic
ggattcacctttaacagttacgcc

SEQ ID NO: 3244 - protein, 8 aa, Artificial Sequence
  synthetic
GFTFNSYA

SEQ ID NO: 3245 - DNA, 24 bp, Artificial Sequence
  synthetic
attattttcagtggtggtatcata

SEQ ID NO: 3246 - protein, 8 aa, Artificial Sequence
  synthetic
IIFSGGII

SEQ ID NO: 3247 - DNA, 45 bp, Artificial Sequence
  synthetic
gcgaaagcctcagccactataacgacaaaggacggtttggacgtc

SEQ ID NO: 3248 - protein, 15 aa, Artificial Sequence
  synthetic
AKASATITTKDGLDV

SEQ ID NO: 3249 - DNA, 324 bp, Artificial Sequence
  synthetic
gacatcctgatgacccagtctccatcctccctgtctgcatctgtgggagacagagtcaatatcacttgccgggcaagtcagggcatcagaaatgatttaggctggtatcagcagagaccagggaaagcccctacgctcctgatctatgctgcatccagtttacaaagtggggtcccatctaggttcagcggcagtggatctggcacagatttcactctcaccatcagcagcctgcagcctgaggattttgcaacttattactgtctacaggattacaattaccctcggacgttcggccaagggaccaaggtggagatcaaacga

SEQ ID NO: 3250 - protein, 108 aa, Artificial Sequence
  synthetic
DILMTQSPSSLSASVGDRVNITCRASQGIRNDLGWYQQRPGKAPTLLIYAASSLQSGVPSRFSGSGSGTDFTLTISSLQPEDFATYYCLQDYNYPRTFGQGTKVEIKR

SEQ ID NO: 3251 - DNA, 18 bp, Artificial Sequence
  synthetic
cagggcatcagaaatgat

SEQ ID NO: 3252 - protein, 6 aa, Artificial Sequence
  synthetic
QGIRND

SEQ ID NO: 3253 - DNA, 9 bp, Artificial Sequence
  synthetic
gctgcatcc

SEQ ID NO: 3254 - protein, 3 aa, Artificial Sequence
  synthetic
AAS

SEQ ID NO: 3255 - DNA, 27 bp, Artificial Sequence
  synthetic
ctacaggattacaattaccctcggacg

SEQ ID NO: 3256 - protein, 9 aa, Artificial Sequence
  synthetic
LQDYNYPRT

SEQ ID NO: 3257 - DNA, 363 bp, Artificial Sequence
  synthetic
caggtgcagctggtgcagtggggcgcaggactgttgaagccttcggagaccctgtccctcacctgcgttgtgtatagtggatccctcagtggttactactggagctggatccggcagtccccagggaagggactggagtggattggggaaatcgatcatactggaagcaccaactacaacccgtccctcaagagtcgagtcaccatatcagtagacacgtccaagaaccagttctcactgaggctgacctctgtgaccgccgcggacacggctgtttattactgtgcgagagggtctcgtataacagatcgagactggtacttcgatccctggggccgtggctccctggtcaccgtctcctca

SEQ ID NO: 3258 - protein, 121 aa, Artificial Sequence
  synthetic
QVQLVQWGAGLLKPSETLSLTCVVYSGSLSGYYWSWIRQSPGKGLEWIGEIDHTGSTNYNPSLKSRVTISVDTSKNQFSLRLTSVTAADTAVYYCARGSRITDRDWYFDPWGRGSLVTVSS

SEQ ID NO: 3259 - DNA, 24 bp, Artificial Sequence
  synthetic
agtggatccctcagtggttactac

SEQ ID NO: 3260 - protein, 8 aa, Artificial Sequence
  synthetic
SGSLSGYY

SEQ ID NO: 3261 - DNA, 21 bp, Artificial Sequence
  synthetic
atcgatcatactggaagcacc

SEQ ID NO: 3262 - protein, 7 aa, Artificial Sequence
  synthetic
IDHTGST

SEQ ID NO: 3263 - DNA, 45 bp, Artificial Sequence
  synthetic
gcgagagggtctcgtataacagatcgagactggtacttcgatccc

SEQ ID NO: 3264 - protein, 15 aa, Artificial Sequence
  synthetic
ARGSRITDRDWYFDP

SEQ ID NO: 3265 - DNA, 324 bp, Artificial Sequence
  synthetic
gacatcgtgatgacccagtctccagccaccctgtctgtgtctccaggggaaagagccaccctctcctgcaggaccagtcagagtattaccagccacttcgcctggtaccagcagaaacctggccaggctcccaggctcctcatctatggtgcatccaccagggccactggtatcccagccaggttcagtggcagtgggtctgggacagagttcactctcaccatcagcagcctacagtctgaagattttgcagtttattactgtcagcaatatgataactggccgtacacttttggccaggggaccaaggtggagatcaaacga

SEQ ID NO: 3266 - protein, 108 aa, Artificial Sequence
  synthetic
DIVMTQSPATLSVSPGERATLSCRTSQSITSHFAWYQQKPGQAPRLLIYGASTRATGIPARFSGSGSGTEFTLTISSLQSEDFAVYYCQQYDNWPYTFGQGTKVEIKR

SEQ ID NO: 3267 - DNA, 18 bp, Artificial Sequence
  synthetic
cagagtattaccagccac

SEQ ID NO: 3268 - protein, 6 aa, Artificial Sequence
  synthetic
QSITSH

SEQ ID NO: 3269 - DNA, 9 bp, Artificial Sequence
  synthetic
ggtgcatcc

SEQ ID NO: 3270 - protein, 3 aa, Artificial Sequence
  synthetic
GAS

SEQ ID NO: 3271 - DNA, 27 bp, Artificial Sequence
  synthetic
cagcaatatgataactggccgtacact

SEQ ID NO: 3272 - protein, 9 aa, Artificial Sequence
  synthetic
QQYDNWPYT

SEQ ID NO: 3273 - DNA, 363 bp, Artificial Sequence
  synthetic
caggtgcagctggtgcagtggggcgcaggactgttgaagccttcggagaccctgtccctcacctgcactgtctatggtgggaccctcagtggttactattggagctggatccgccagcccccagggaaggggctggagtggattggggaaatcgatcatactggaagcaccaacttcaatccgtccctcaagagtcgagtcaccatatcagtagacccgtccaagaaccagttctccctgaatctgagctctgtgaccgccgcggacacggctgtgtatttctgtgcgagaggctctcttataacatctcgagactggttcttcgatctctggggccgtggcaccctggtcaccgtctcctca

SEQ ID NO: 3274 - protein, 121 aa, Artificial Sequence
  synthetic
QVQLVQWGAGLLKPSETLSLTCTVYGGTLSGYYWSWIRQPPGKGLEWIGEIDHTGSTNFNPSLKSRVTISVDPSKNQFSLNLSSVTAADTAVYFCARGSLITSRDWFFDLWGRGTLVTVSS

SEQ ID NO: 3275 - DNA, 24 bp, Artificial Sequence
  synthetic
ggtgggaccctcagtggttactat

SEQ ID NO: 3276 - protein, 8 aa, Artificial Sequence
  synthetic
GGTLSGYY

SEQ ID NO: 3277 - DNA, 21 bp, Artificial Sequence
  synthetic
atcgatcatactggaagcacc

SEQ ID NO: 3278 - protein, 7 aa, Artificial Sequence
  synthetic
IDHTGST

SEQ ID NO: 3279 - DNA, 45 bp, Artificial Sequence
  synthetic
gcgagaggctctcttataacatctcgagactggttcttcgatctc

SEQ ID NO: 3280 - protein, 15 aa, Artificial Sequence
  synthetic
ARGSLITSRDWFFDL

SEQ ID NO: 3281 - DNA, 324 bp, Artificial Sequence
  synthetic
gacatcgtgatgacccagtctccagccaccctgtctgtgtctccaggggaaagagccaccctctcctgcagggccagtcagagtcttagcagcaacttagcctggtaccagcagagacctggccaggctcccaggctcctcatctatggtgcatccaccagggccactggtatcccagccaggttcagtggcagtgggtctgggacagagttcactctcaccatcagcagcctgcagtctgaagattttgcagtttattgctgtcagcaatatgataactggccgtacacttttggccaggggaccaaggtggagatcaaacga

SEQ ID NO: 3282 - protein, 108 aa, Artificial Sequence
  synthetic
DIVMTQSPATLSVSPGERATLSCRASQSLSSNLAWYQQRPGQAPRLLIYGASTRATGIPARFSGSGSGTEFTLTISSLQSEDFAVYCCQQYDNWPYTFGQGTKVEIKR

SEQ ID NO: 3283 - DNA, 18 bp, Artificial Sequence
  synthetic
cagagtcttagcagcaac

SEQ ID NO: 3284 - protein, 6 aa, Artificial Sequence
  synthetic
QSLSSN

SEQ ID NO: 3285 - DNA, 9 bp, Artificial Sequence
  synthetic
ggtgcatcc

SEQ ID NO: 3286 - protein, 3 aa, Artificial Sequence
  synthetic
GAS

SEQ ID NO: 3287 - DNA, 27 bp, Artificial Sequence
  synthetic
cagcaatatgataactggccgtacact

SEQ ID NO: 3288 - protein, 9 aa, Artificial Sequence
  synthetic
QQYDNWPYT

SEQ ID NO: 3289 - DNA, 363 bp, Artificial Sequence
  synthetic
caggtgcagctggtgcagtggggcgcaggcctgttgaagccttcggagaccctgtccctcacctgcgctgtctatggtgggtccttcagtggttactactggagctggatccgccagcccccagggaaggggctggagtggattggggaaatcgatcatactggaagcaccaactacaacccgtccctcaagagtcgagtcaccatttcagtagacacgtccaagaaccagttctccctgaagctgagttctgtgaccgccgcggacacggctgtgtattattgtgcgagaggctctcttataacatctcgagactggcacttcgatctctggggccgtggcaccctggtcaccgtctcctca

SEQ ID NO: 3290 - protein, 121 aa, Artificial Sequence
  synthetic
QVQLVQWGAGLLKPSETLSLTCAVYGGSFSGYYWSWIRQPPGKGLEWIGEIDHTGSTNYNPSLKSRVTISVDTSKNQFSLKLSSVTAADTAVYYCARGSLITSRDWHFDLWGRGTLVTVSS

SEQ ID NO: 3291 - DNA, 24 bp, Artificial Sequence
  synthetic
ggtgggtccttcagtggttactac

SEQ ID NO: 3292 - protein, 8 aa, Artificial Sequence
  synthetic
GGSFSGYY

SEQ ID NO: 3293 - DNA, 21 bp, Artificial Sequence
  synthetic
atcgatcatactggaagcacc

SEQ ID NO: 3294 - protein, 7 aa, Artificial Sequence
  synthetic
IDHTGST

SEQ ID NO: 3295 - DNA, 45 bp, Artificial Sequence
  synthetic
gcgagaggctctcttataacatctcgagactggcacttcgatctc

SEQ ID NO: 3296 - protein, 15 aa, Artificial Sequence
  synthetic
ARGSLITSRDWHFDL

SEQ ID NO: 3297 - DNA, 324 bp, Artificial Sequence
  synthetic
gacatcgtgatgacccagtctccagccaccctgtctgtgtctccaggggaaagagccaccctctcctgcagggccagtcagagtgttagcagcaacttagcctggtaccagcagaaacctggccaggctcccaggctcctcatctatggtgcttccaccagggccactggtatcccagccaggttcagtggcagtgggtctgggacagagttcactctcaccatcagcagcctgcagtctgaagattttgcagtttattactgtcagcagtatgataactggccgtacacttttggccaggggaccaaggtggagatcaaacga

SEQ ID NO: 3298 - protein, 108 aa, Artificial Sequence
  synthetic
DIVMTQSPATLSVSPGERATLSCRASQSVSSNLAWYQQKPGQAPRLLIYGASTRATGIPARFSGSGSGTEFTLTISSLQSEDFAVYYCQQYDNWPYTFGQGTKVEIKR

SEQ ID NO: 3299 - DNA, 18 bp, Artificial Sequence
  synthetic
cagagtgttagcagcaac

SEQ ID NO: 3300 - protein, 6 aa, Artificial Sequence
  synthetic
QSVSSN

SEQ ID NO: 3301 - DNA, 9 bp, Artificial Sequence
  synthetic
ggtgcttcc

SEQ ID NO: 3302 - protein, 3 aa, Artificial Sequence
  synthetic
GAS

SEQ ID NO: 3303 - DNA, 27 bp, Artificial Sequence
  synthetic
cagcagtatgataactggccgtacact

SEQ ID NO: 3304 - protein, 9 aa, Artificial Sequence
  synthetic
QQYDNWPYT

SEQ ID NO: 3305 - DNA, 363 bp, Artificial Sequence
  synthetic
caggtgcagctggtgcagtggggcgcaggactgttgaagccttcggagaccctgtccctcacctgcgctgtctatggtgggtccatcagtgtttactactggagcttgatccgccagcccccagggaaggggctggagtggattggggaaatcgatcatactggaagcaccaactacaacccgtccctcaagagtcgagtcaccatatcagtagacacgtccgagaaccagttctccctgaagctgacctctgtgaccgccgcggacacggctgtgtattactgtgcgagaggctctcttataacagatcgagactggtacttcgatctctggggccgtggcaccctggtcaccgtctcctca

SEQ ID NO: 3306 - protein, 121 aa, Artificial Sequence
  synthetic
QVQLVQWGAGLLKPSETLSLTCAVYGGSISVYYWSLIRQPPGKGLEWIGEIDHTGSTNYNPSLKSRVTISVDTSENQFSLKLTSVTAADTAVYYCARGSLITDRDWYFDLWGRGTLVTVSS

SEQ ID NO: 3307 - DNA, 24 bp, Artificial Sequence
  synthetic
ggtgggtccatcagtgtttactac

SEQ ID NO: 3308 - protein, 8 aa, Artificial Sequence
  synthetic
GGSISVYY

SEQ ID NO: 3309 - DNA, 21 bp, Artificial Sequence
  synthetic
atcgatcatactggaagcacc

SEQ ID NO: 3310 - protein, 7 aa, Artificial Sequence
  synthetic
IDHTGST

SEQ ID NO: 3311 - DNA, 45 bp, Artificial Sequence
  synthetic
gcgagaggctctcttataacagatcgagactggtacttcgatctc

SEQ ID NO: 3312 - protein, 15 aa, Artificial Sequence
  synthetic
ARGSLITDRDWYFDL

SEQ ID NO: 3313 - DNA, 324 bp, Artificial Sequence
  synthetic
gacatcgtgatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgctcactttcggcggagggaccaaggtggagatcaaacga

SEQ ID NO: 3314 - protein, 108 aa, Artificial Sequence
  synthetic
DIVMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIKR

SEQ ID NO: 3315 - DNA, 18 bp, Artificial Sequence
  synthetic
caggacattagcaactat

SEQ ID NO: 3316 - protein, 6 aa, Artificial Sequence
  synthetic
QDISNY

SEQ ID NO: 3317 - DNA, 9 bp, Artificial Sequence
  synthetic
gatgcatcc

SEQ ID NO: 3318 - protein, 3 aa, Artificial Sequence
  synthetic
DAS

SEQ ID NO: 3319 - DNA, 27 bp, Artificial Sequence
  synthetic
caacagtatgataatctcccgctcact

SEQ ID NO: 3320 - protein, 9 aa, Artificial Sequence
  synthetic
QQYDNLPLT

SEQ ID NO: 3321 - DNA, 363 bp, Artificial Sequence
  synthetic
caggtgcagctggtgcagtggggcgcaggactgttgaagccttcggagaccctgtccctcacctgcgctgtctatggtgggtccctcagtggttactactggagctggatccgccagcccccagggaaggggctggaatggattggggaaatcgatcatactggaagcaccaactacaatccgtccctcaagagtcgagtcaccatatccgtcgacacgtcccagaaccagctctccctgaagttgacctctgtgaccgccgcggacacggctgtgtacttttgtgcgagaggctctcttataacagatcgagactggtacttcgatttctggggccgtggcaccctggtcaccgtctcctca

SEQ ID NO: 3322 - protein, 121 aa, Artificial Sequence
  synthetic
QVQLVQWGAGLLKPSETLSLTCAVYGGSLSGYYWSWIRQPPGKGLEWIGEIDHTGSTNYNPSLKSRVTISVDTSQNQLSLKLTSVTAADTAVYFCARGSLITDRDWYFDFWGRGTLVTVSS

SEQ ID NO: 3323 - DNA, 24 bp, Artificial Sequence
  synthetic
ggtgggtccctcagtggttactac

SEQ ID NO: 3324 - protein, 8 aa, Artificial Sequence
  synthetic
GGSLSGYY

SEQ ID NO: 3325 - DNA, 21 bp, Artificial Sequence
  synthetic
atcgatcatactggaagcacc

SEQ ID NO: 3326 - protein, 7 aa, Artificial Sequence
  synthetic
IDHTGST

SEQ ID NO: 3327 - DNA, 45 bp, Artificial Sequence
  synthetic
gcgagaggctctcttataacagatcgagactggtacttcgatttc

SEQ ID NO: 3328 - protein, 15 aa, Artificial Sequence
  synthetic
ARGSLITDRDWYFDF

SEQ ID NO: 3329 - DNA, 324 bp, Artificial Sequence
  synthetic
gacatcgtgatgacccagtctccagccaccctgtctgtgtctccaggggaaagagccaccctctcctgcagggccagtcagagtattagcagccacttagcctggtaccagcagaaacctggccaggctcccaggctcctcatctatggtgcatccaccaggtccactggtatcccagccaggttcagtggcagtgggtctgggacagagttcactctcaccatcagcagcctgcagtctgaagattttgcagtttattactgtcaacaatataatgactggccgtacacttttggccaggggaccaaggtggagatcaaacga

SEQ ID NO: 3330 - protein, 108 aa, Artificial Sequence
  synthetic
DIVMTQSPATLSVSPGERATLSCRASQSISSHLAWYQQKPGQAPRLLIYGASTRSTGIPARFSGSGSGTEFTLTISSLQSEDFAVYYCQQYNDWPYTFGQGTKVEIKR

SEQ ID NO: 3331 - DNA, 18 bp, Artificial Sequence
  synthetic
cagagtattagcagccac

SEQ ID NO: 3332 - protein, 6 aa, Artificial Sequence
  synthetic
QSISSH

SEQ ID NO: 3333 - DNA, 9 bp, Artificial Sequence
  synthetic
ggtgcatcc

SEQ ID NO: 3334 - protein, 3 aa, Artificial Sequence
  synthetic
GAS

SEQ ID NO: 3335 - DNA, 27 bp, Artificial Sequence
  synthetic
caacaatataatgactggccgtacact

SEQ ID NO: 3336 - protein, 9 aa, Artificial Sequence
  synthetic
QQYNDWPYT

SEQ ID NO: 3337 - DNA, 363 bp, Artificial Sequence
  synthetic
caggtgcagctggtgcagtggggcgcaggactgttgaagccttcggagaccctgtccctcacctgcgctgtctatggtgggtccctcagtggttactactggaactggatccgccagcccccagggaaggggctggcgtggattggggaaatcgatcatactggaagcaccaactacaacccgtccctcaagagtcgagtcaccatatcagtagacacgtccaagaaccagttctccctgaagctgacctctgtgaccgccgcggacacggctgtgtattactgtgcgagaggctctcgtataacagatcgagactggtacttcgatctctggggccgtggcaccctggtcaccgtctcctca

SEQ ID NO: 3338 - protein, 121 aa, Artificial Sequence
  synthetic
QVQLVQWGAGLLKPSETLSLTCAVYGGSLSGYYWNWIRQPPGKGLAWIGEIDHTGSTNYNPSLKSRVTISVDTSKNQFSLKLTSVTAADTAVYYCARGSRITDRDWYFDLWGRGTLVTVSS

SEQ ID NO: 3339 - DNA, 24 bp, Artificial Sequence
  synthetic
ggtgggtccctcagtggttactac

SEQ ID NO: 3340 - protein, 8 aa, Artificial Sequence
  synthetic
GGSLSGYY

SEQ ID NO: 3341 - DNA, 21 bp, Artificial Sequence
  synthetic
atcgatcatactggaagcacc

SEQ ID NO: 3342 - protein, 7 aa, Artificial Sequence
  synthetic
IDHTGST

SEQ ID NO: 3343 - DNA, 45 bp, Artificial Sequence; identical to SEQ ID NO: 3167
  synthetic

SEQ ID NO: 3344 - protein, 15 aa, Artificial Sequence
  synthetic
ARGSRITDRDWYFDL

SEQ ID NO: 3345 - DNA, 324 bp, Artificial Sequence
  synthetic
gacatcgtgatgacccagtctccagccaccctgtctgtgtctccaggggaaagagccaccctctcctgcagggccagtcagagtgttagcagcaactttgcctggtaccagcagaaacctggccaggctcccaggctcctcctctatggtggatccaccagggccactggtatcccagccaggttcagtggcagtgggtctgggacagagttcactctcaccatcagcagcctgcagtctgaagattttgcagtttattactgtcagcattatgataactggccgtacacttttggccaggggaccaaggtggagatcaaacga

SEQ ID NO: 3346 - protein, 108 aa, Artificial Sequence
  synthetic
DIVMTQSPATLSVSPGERATLSCRASQSVSSNFAWYQQKPGQAPRLLLYGGSTRATGIPARFSGSGSGTEFTLTISSLQSEDFAVYYCQHYDNWPYTFGQGTKVEIKR

SEQ ID NO: 3347 - DNA, 18 bp, Artificial Sequence
  synthetic
cagagtgttagcagcaac

SEQ ID NO: 3348 - protein, 6 aa, Artificial Sequence
  synthetic
QSVSSN

SEQ ID NO: 3349 - DNA, 9 bp, Artificial Sequence
  synthetic
ggtggatcc

SEQ ID NO: 3350 - protein, 3 aa, Artificial Sequence
  synthetic
GGS

SEQ ID NO: 3351 - DNA, 27 bp, Artificial Sequence
  synthetic
cagcattatgataactggccgtacact

SEQ ID NO: 3352 - protein, 9 aa, Artificial Sequence
  synthetic
QHYDNWPYT

SEQ ID NO: 3353 - DNA, 363 bp, Artificial Sequence
  synthetic
caggtgcagctggtgcagtggggcgcaggactgttgaagccttcggagaccctgtccctcacctgcgttgtggatagtggatccctcagtggttactactggagctggatccggcagcccccagggaagggactggagtggattggggaaatcgatcatactggaagcaccaactacaacccgtccctcaagagtcgagtcaccatatctgtagacacgtccaagaaccagttctcactgaggctgacctctgtgaccgccgcggacacggctgtttattactgtgcgagagggtctcgtataacagatcgagactggtatttcgatccctggggccgtggctccctggtcaccgtctcctca

SEQ ID NO: 3354 - protein, 121 aa, Artificial Sequence
  synthetic
QVQLVQWGAGLLKPSETLSLTCVVDSGSLSGYYWSWIRQPPGKGLEWIGEIDHTGSTNYNPSLKSRVTISVDTSKNQFSLRLTSVTAADTAVYYCARGSRITDRDWYFDPWGRGSLVTVSS

SEQ ID NO: 3355 - DNA, 24 bp, Artificial Sequence
  synthetic
agtggatccctcagtggttactac

SEQ ID NO: 3356 - protein, 8 aa, Artificial Sequence
  synthetic
SGSLSGYY

SEQ ID NO: 3357 - DNA, 21 bp, Artificial Sequence
  synthetic
atcgatcatactggaagcacc

SEQ ID NO: 3358 - protein, 7 aa, Artificial Sequence
  synthetic
IDHTGST

SEQ ID NO: 3359 - DNA, 45 bp, Artificial Sequence
  synthetic
gcgagagggtctcgtataacagatcgagactggtatttcgatccc

SEQ ID NO: 3360 - protein, 15 aa, Artificial Sequence
  synthetic
ARGSRITDRDWYFDP

SEQ ID NO: 3361 - DNA, 324 bp, Artificial Sequence
  synthetic
gacatcgtgatgacccagtctccagccaccctgtctgtgtctccaggggaaagagccaccctctcctgcaggaccagtcagagtattaccagccacttcgcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcaatatgataactggccgtacacttttggccaggggaccaaggtggagatcaaacga

SEQ ID NO: 3362 - protein, 108 aa, Artificial Sequence; identical to SEQ ID NO: 3266
  synthetic

SEQ ID NO: 3363 - DNA, 18 bp, Artificial Sequence
  synthetic
cagagtattaccagccac

SEQ ID NO: 3364 - protein, 6 aa, Artificial Sequence
  synthetic
QSITSH

SEQ ID NO: 3365 - DNA, 9 bp, Artificial Sequence
  synthetic
ggtgcatcc

SEQ ID NO: 3366 - protein, 3 aa, Artificial Sequence
  synthetic
GAS

SEQ ID NO: 3367 - DNA, 27 bp, Artificial Sequence
  synthetic
cagcaatatgataactggccgtacact

SEQ ID NO: 3368 - protein, 9 aa, Artificial Sequence
  synthetic
QQYDNWPYT

SEQ ID NO: 3369 - DNA, 363 bp, Artificial Sequence
  synthetic
caggtgcagctggtgcagtggggcgcaggactgttgaagccttcggagaccctgtccctcacctgcgctgtctatggtgggtccctcagtggttactactggagctggatccgccagcccccagggaaggggctggaatggattggggaaatcgatcatactggaagtaccaactacaatccgtccctcaagagtcgagtcaccatatccgtcgacacgtcccagaaccagctctccctgaagttgacctctgtgaccgccgcggacacggctgtgtacttctgtgcgagaggctctcttataacagatcgagactggtacttcgatctctggggccgtggcaccctggtcaccgtctcctca

SEQ ID NO: 3370 - protein, 121 aa, Artificial Sequence
  synthetic
QVQLVQWGAGLLKPSETLSLTCAVYGGSLSGYYWSWIRQPPGKGLEWIGEIDHTGSTNYNPSLKSRVTISVDTSQNQLSLKLTSVTAADTAVYFCARGSLITDRDWYFDLWGRGTLVTVSS

SEQ ID NO: 3371 - DNA, 24 bp, Artificial Sequence
  synthetic
ggtgggtccctcagtggttactac

SEQ ID NO: 3372 - protein, 8 aa, Artificial Sequence
  synthetic
GGSLSGYY

SEQ ID NO: 3373 - DNA, 21 bp, Artificial Sequence
  synthetic
atcgatcatactggaagtacc

SEQ ID NO: 3374 - protein, 7 aa, Artificial Sequence
  synthetic
IDHTGST

SEQ ID NO: 3375 - DNA, 45 bp, Artificial Sequence; identical to SEQ ID NO: 3311
  synthetic

SEQ ID NO: 3376 - protein, 15 aa, Artificial Sequence
  synthetic
ARGSLITDRDWYFDL

SEQ ID NO: 3377 - DNA, 324 bp, Artificial Sequence
  synthetic
gacatcgtgatgacccagtctccaggcaccctgtctgtgtctccaggggaaagagccaccctctcctgcagggccagtcagagtattagcagccacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttggagtttattactgtcaacaatataatgactggccgtacacttttggccaggggaccaaggtggagatcaaacga

SEQ ID NO: 3378 - protein, 108 aa, Artificial Sequence
  synthetic
DIVMTQSPGTLSVSPGERATLSCRASQSISSHLAWYQQKPGQAPRLLIYGASTRATGIPARFSGSGSGTEFTLTISSLQSEDFGVYYCQQYNDWPYTFGQGTKVEIKR

SEQ ID NO: 3379 - DNA, 18 bp, Artificial Sequence
  synthetic
cagagtattagcagccac

SEQ ID NO: 3380 - protein, 6 aa, Artificial Sequence
  synthetic
QSISSH

SEQ ID NO: 3381 - DNA, 9 bp, Artificial Sequence
  synthetic
ggtgcatcc

SEQ ID NO: 3382 - protein, 3 aa, Artificial Sequence
  synthetic
GAS

SEQ ID NO: 3383 - DNA, 27 bp, Artificial Sequence
  synthetic
caacaatataatgactggccgtacact

SEQ ID NO: 3384 - protein, 9 aa, Artificial Sequence
  synthetic
QQYNDWPYT

SEQ ID NO: 3385 - DNA, 363 bp, Artificial Sequence
  synthetic
caggtgcagctggtgcagtggggcgcaggactgttgaagccttcggagaccctgtccctcacctgcgctgtgtatggtggatccttaagtggttactactggagctggatccggcagcccccagggaagggactggagtggattggggaaatcgatcatactggaagcaccaactacaacccgtccctcaagagtcgactcaccatatcagtggacacgtccaggaaccaattctcactgaagctgagttctgtgaccgccgcggacacggctgtttattactgtacgagagggtctcgtataacagatcgagactggtacttcgatctctggggccgtggcaccctggtcaccgtctcctca

SEQ ID NO: 3386 - protein, 121 aa, Artificial Sequence
  synthetic
QVQLVQWGAGLLKPSETLSLTCAVYGGSLSGYYWSWIRQPPGKGLEWIGEIDHTGSTNYNPSLKSRLTISVDTSRNQFSLKLSSVTAADTAVYYCTRGSRITDRDWYFDLWGRGTLVTVSS

SEQ ID NO: 3387 - DNA, 24 bp, Artificial Sequence
  synthetic
ggtggatccttaagtggttactac

SEQ ID NO: 3388 - protein, 8 aa, Artificial Sequence
  synthetic
GGSLSGYY

SEQ ID NO: 3389 - DNA, 21 bp, Artificial Sequence
  synthetic
atcgatcatactggaagcacc

SEQ ID NO: 3390 - protein, 7 aa, Artificial Sequence
  synthetic
IDHTGST

SEQ ID NO: 3391 - DNA, 45 bp, Artificial Sequence
  synthetic
acgagagggtctcgtataacagatcgagactggtacttcgatctc

SEQ ID NO: 3392 - protein, 15 aa, Artificial Sequence
  synthetic
TRGSRITDRDWYFDL

SEQ ID NO: 3393 - DNA, 327 bp, Artificial Sequence
  synthetic
gacatcgtgatgacccagtctccttccaccctgtctgcatctgtgggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcccaattcactttcggccctgggaccaaggtggagatcaaacga

SEQ ID NO: 3394 - protein, 109 aa, Artificial Sequence
  synthetic
DIVMTQSPSTLSASVGDRVTITCRASQSISSWLAWYQQKPGKAPKLLIYKASSLESGVPSRFSGSGSGTEFTLTISSLQPDDFATYYCQQYNSYSQFTFGPGTKVEIKR

SEQ ID NO: 3395 - DNA, 18 bp, Artificial Sequence
  synthetic
cagagtattagtagctgg

SEQ ID NO: 3396 - protein, 6 aa, Artificial Sequence
  synthetic
QSISSW

SEQ ID NO: 3397 - DNA, 9 bp, Artificial Sequence
  synthetic
aaggcgtct

SEQ ID NO: 3398 - protein, 3 aa, Artificial Sequence
  synthetic
KAS

SEQ ID NO: 3399 - DNA, 30 bp, Artificial Sequence
  synthetic
caacagtataatagttattcccaattcact

SEQ ID NO: 3400 - protein, 10 aa, Artificial Sequence
  synthetic
QQYNSYSQFT

SEQ ID NO: 3401 - DNA, 363 bp, Artificial Sequence
  synthetic
caggtgcagctggtgcagtggggcgcaggactgttgaagcctgcggagaccctgtccctcacctgcgctgtctatggtgggtccctcagtggctactattggagctggatccgccagcccccagggaaggggctggagtggattggggaaatcgatcatactggaagtaccaactacaatccgtccctcaagagtcgagtcaccatatcagtcgacacgtccaagaacctactctccctgaggctgacttctgtgaccgacgcggacacggctgtgtattactgtgcgagaggcactcttatcacagatcgagactggtacttcggtctctggggccgtggctccctggtcaccgtctcctca

SEQ ID NO: 3402 - protein, 121 aa, Artificial Sequence
  synthetic
QVQLVQWGAGLLKPAETLSLTCAVYGGSLSGYYWSWIRQPPGKGLEWIGEIDHTGSTNYNPSLKSRVTISVDTSKNLLSLRLTSVTDADTAVYYCARGTLITDRDWYFGLWGRGSLVTVSS

SEQ ID NO: 3403 - DNA, 24 bp, Artificial Sequence
  synthetic
ggtgggtccctcagtggctactat

SEQ ID NO: 3404 - protein, 8 aa, Artificial Sequence
  synthetic
GGSLSGYY

SEQ ID NO: 3405 - DNA, 21 bp, Artificial Sequence
  synthetic
atcgatcatactggaagtacc

SEQ ID NO: 3406 - protein, 7 aa, Artificial Sequence
  synthetic
IDHTGST

SEQ ID NO: 3407 - DNA, 45 bp, Artificial Sequence
  synthetic
gcgagaggcactcttatcacagatcgagactggtacttcggtctc

SEQ ID NO: 3408 - protein, 15 aa, Artificial Sequence
  synthetic
ARGTLITDRDWYFGL

SEQ ID NO: 3409 - DNA, 324 bp, Artificial Sequence
  synthetic
gacatcgtgatgacccagtctccagccaccctgtctgtgtctccaggggaaagagccaccctctcctgcagagccagtcagagtattagtgaccacttagcctggtaccagcagaaacctggccaggctcccaggctcctcatctatggtgaatccaccagggccactggtatcccagccaggttcagtggcagtgggtctgggacagagttcactctcaccatcagcagcctgcagtctgaagattttgcagtttattactgtcagcagtataataactggccgtacacttttggccaggggaccaaggtggagatcaaacga

SEQ ID NO: 3410 - protein, 108 aa, Artificial Sequence
  synthetic
DIVMTQSPATLSVSPGERATLSCRASQSISDHLAWYQQKPGQAPRLLIYGESTRATGIPARFSGSGSGTEFTLTISSLQSEDFAVYYCQQYNNWPYTFGQGTKVEIKR

SEQ ID NO: 3411 - DNA, 18 bp, Artificial Sequence
  synthetic
cagagtattagtgaccac

SEQ ID NO: 3412 - protein, 6 aa, Artificial Sequence
  synthetic
QSISDH

SEQ ID NO: 3413 - DNA, 9 bp, Artificial Sequence
  synthetic
ggtgaatcc

SEQ ID NO: 3414 - protein, 3 aa, Artificial Sequence
  synthetic
GES

SEQ ID NO: 3415 - DNA, 27 bp, Artificial Sequence
  synthetic
cagcagtataataactggccgtacact

SEQ ID NO: 3416 - protein, 9 aa, Artificial Sequence
  synthetic
QQYNNWPYT

SEQ ID NO: 3417 - DNA, 363 bp, Artificial Sequence
  synthetic
caggtgcagctggtgcagtggggcgcaggactgttgaagccttcggagaccctgtccctcacctgcgctgtctatggtgggtccctcaatggttactactggaactggatccgccagcccccagggaaggggctggagtggattggggaaatcgatcatactggaagcaccaacttcaatccgtccctcaagagtcgagtcaccatatcagtcgacacgtccaagagccagctctccctgaagctgagctctgtgaccgccgcggacacggctgtttactactgtgcgaaaggctctcttattacagatcgagactggtacttcgatctctggggccgtggcaccctggtcaccgtctcctca

SEQ ID NO: 3418 - protein, 121 aa, Artificial Sequence
  synthetic
QVQLVQWGAGLLKPSETLSLTCAVYGGSLNGYYWNWIRQPPGKGLEWIGEIDHTGSTNFNPSLKSRVTISVDTSKSQLSLKLSSVTAADTAVYYCAKGSLITDRDWYFDLWGRGTLVTVSS

SEQ ID NO: 3419 - DNA, 24 bp, Artificial Sequence
  synthetic
ggtgggtccctcaatggttactac

SEQ ID NO: 3420 - protein, 8 aa, Artificial Sequence
  synthetic
GGSLNGYY

SEQ ID NO: 3421 - DNA, 21 bp, Artificial Sequence
  synthetic
atcgatcatactggaagcacc

SEQ ID NO: 3422 - protein, 7 aa, Artificial Sequence
  synthetic
IDHTGST

SEQ ID NO: 3423 - DNA, 45 bp, Artificial Sequence
  synthetic
gcgaaaggctctcttattacagatcgagactggtacttcgatctc

SEQ ID NO: 3424 - protein, 15 aa, Artificial Sequence
  synthetic
AKGSLITDRDWYFDL

SEQ ID NO: 3425 - DNA, 324 bp, Artificial Sequence
  synthetic
gacatcgtgatgacccagtctccagccaccctgtctgtgtctccaggggaaagagccaccctctcctgcagggccagtcatagtattagcagccacttcgcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcaacactataataactggccgtacacttttggccaggggaccaaggtggagatcaaacga

SEQ ID NO: 3426 - protein, 108 aa, Artificial Sequence
  synthetic
DIVMTQSPATLSVSPGERATLSCRASHSISSHFAWYQQKPGQAPRLLIYGASTRATGIPARFSGSGSGTEFTLTISSLQSEDFAVYYCQHYNNWPYTFGQGTKVEIKR

SEQ ID NO: 3427 - DNA, 18 bp, Artificial Sequence
  synthetic
catagtattagcagccac

SEQ ID NO: 3428 - protein, 6 aa, Artificial Sequence
  synthetic
HSISSH

SEQ ID NO: 3429 - DNA, 9 bp, Artificial Sequence
  synthetic
ggtgcatcc

SEQ ID NO: 3430 - protein, 3 aa, Artificial Sequence
  synthetic
GAS

SEQ ID NO: 3431 - DNA, 27 bp, Artificial Sequence
  synthetic
caacactataataactggccgtacact

SEQ ID NO: 3432 - protein, 9 aa, Artificial Sequence
  synthetic
QHYNNWPYT

SEQ ID NO: 3433 - DNA, 363 bp, Artificial Sequence
  synthetic
gaggtgcagctggtggagtctgggggaggcgtggtccagcctgggaggtccctgagactgtcctgtgcagcgtccggattcaccttcagtacctatggcatgcactgggtccgccaggctccaggcaaggggctggagtgggtggcagttatatggtatgatggaaataagaaatactatggagactccgtgaagggccgattcaccatatccagagacaattccaagaacacgctgtatctgcaaatgaacagcctgagagccgaggacacggctgtgtattactgtgcgagacagtccggtatagtgggagctaccccatttgactactggggccagggaaccctggtcaccgtctcctca

SEQ ID NO: 3434 - protein, 121 aa, Artificial Sequence
  synthetic
EVQLVESGGGVVQPGRSLRLSCAASGFTFSTYGMHWVRQAPGKGLEWVAVIWYDGNKKYYGDSVKGRFTISRDNSKNTLYLQMNSLRAEDTAVYYCARQSGIVGATPFDYWGQGTLVTVSS

SEQ ID NO: 3435 - DNA, 24 bp, Artificial Sequence
  synthetic
ggattcaccttcagtacctatggc

SEQ ID NO: 3436 - protein, 8 aa, Artificial Sequence
  synthetic
GFTFSTYG

SEQ ID NO: 3437 - DNA, 24 bp, Artificial Sequence
  synthetic
atatggtatgatggaaataagaaa

SEQ ID NO: 3438 - protein, 8 aa, Artificial Sequence
  synthetic
IWYDGNKK

SEQ ID NO: 3439 - DNA, 42 bp, Artificial Sequence
  synthetic
gcgagacagtccggtatagtgggagctaccccatttgactac

SEQ ID NO: 3440 - protein, 14 aa, Artificial Sequence
  synthetic
ARQSGIVGATPFDY

SEQ ID NO: 3441 - DNA, 324 bp, Artificial Sequence
  synthetic
gacatcgtgatgacccagtctccatcctccctgtctgcatctgtaggagacagagtcaccatcacttgccgggcaagtcagagtattagcaggtatttaaattggtatcagcagaaaccagggaaagcccctaagttcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcattttcggccctgggaccaaggtggaaatcaaacga

SEQ ID NO: 3442 - protein, 108 aa, Artificial Sequence
  synthetic
DIVMTQSPSSLSASVGDRVTITCRASQSISRYLNWYQQKPGKAPKFLIYAASSLQSGVPSRFSGSGSGTDFTLTISSLQPEDFATYYCQQSYSTPFIFGPGTKVEIKR

SEQ ID NO: 3443 - DNA, 18 bp, Artificial Sequence
  synthetic
cagagtattagcaggtat

SEQ ID NO: 3444 - protein, 6 aa, Artificial Sequence
  synthetic
QSISRY

SEQ ID NO: 3445 - DNA, 9 bp, Artificial Sequence
  synthetic
gctgcatcc

SEQ ID NO: 3446 - protein, 3 aa, Artificial Sequence
  synthetic
AAS

SEQ ID NO: 3447 - DNA, 27 bp, Artificial Sequence
  synthetic
caacagagttacagtaccccattcatt

SEQ ID NO: 3448 - protein, 9 aa, Artificial Sequence
  synthetic
QQSYSTPFI

SEQ ID NO: 3449 - DNA, 350 bp, Artificial Sequence
  synthetic
gaggtgcagctggtggagtctggaggaggcttggtacagcctggggggtccctgagactctcctgtgcagcctctggattcacctttaccagctactgcatgagctgggtccgccaggctccagggaaggggctggagtgggtctcaattatttatagtggtggtatcagatactacgcagactccgtgaagggccggttcaccatctccagagacaattccaagaacacgctgtatctgcaaatgaacagcctgagagccgaggacacggccatgtattactgtgcgagcgggttagcaactgcggtttggacgtctggggccaagggaccacggtcaccgtctcctca

SEQ ID NO: 3450 - protein, 116 aa, Artificial Sequence
  synthetic
EVQLVESGGGLVQPGGSLRLSCAASGFTFTSYCMSWVRQAPGKGLEWVSIIYSGGIRYYADSVKGRFTISRDNSKNTLYLQMNSLRAEDTAMYYCASGLATAVWTSGAKGPRSPSP

SEQ ID NO: 3451 - DNA, 24 bp, Artificial Sequence
  synthetic
ggattcacctttaccagctactgc

SEQ ID NO: 3452 - protein, 8 aa, Artificial Sequence
  synthetic
GFTFTSYC

SEQ ID NO: 3453 - DNA, 21 bp, Artificial Sequence
  synthetic
atttatagtggtggtatcaga

SEQ ID NO: 3454 - protein, 7 aa, Artificial Sequence
  synthetic
IYSGGIR

SEQ ID NO: 3455 - DNA, 27 bp, Artificial Sequence
  synthetic
gcgagcgggttagcaactgcggtttgg

SEQ ID NO: 3456 - protein, 9 aa, Artificial Sequence
  synthetic
ASGLATAVW

SEQ ID NO: 3457 - DNA, 324 bp, Artificial Sequence
  synthetic
gacatcctgatgacccagtctccatcctccctgtctgcatctgtaggagacagagtcaccatcacttgccgggcaagtcagggcatcagaaatgatttaggctggtatcagcagaaaccagggaaagcccctacgctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaggtggagatcaaacga

SEQ ID NO: 3458 - protein, 108 aa, Artificial Sequence
  synthetic
DILMTQSPSSLSASVGDRVTITCRASQGIRNDLGWYQQKPGKAPTLLIYAASSLQSGVPSRFSGSGSGTDFTLTISSLQPEDFATYYCQQSYSTPLTFGGGTKVEIKR

SEQ ID NO: 3459 - DNA, 18 bp, Artificial Sequence
  synthetic
cagggcatcagaaatgat

SEQ ID NO: 3460 - protein, 6 aa, Artificial Sequence
  synthetic
QGIRND

SEQ ID NO: 3461 - DNA, 9 bp, Artificial Sequence
  synthetic
gctgcatcc

SEQ ID NO: 3462 - protein, 3 aa, Artificial Sequence
  synthetic
AAS

SEQ ID NO: 3463 - DNA, 27 bp, Artificial Sequence
  synthetic
caacagagttacagtaccccgctcact

SEQ ID NO: 3464 - protein, 9 aa, Artificial Sequence
  synthetic
QQSYSTPLT

SEQ ID NO: 3465 - DNA, 363 bp, Artificial Sequence
  synthetic
gaggtgcagctggtggagtctgggggaggcgtggtccagcctgggaggtccctgagactctcctgtgcagcgtctggattcaccttcagtacctataacatgcactgggtccgccaggctccaggcaaggggctggagtgggtggcagttatatggtatgatggaggtaataaatactatacagactccgtgaagggccgattcaccatctccagagacaattccaagaacactctttatctgcaaatgaacagcctgagagccgaggacacggctgtttattactgtgcgagacaatccggtatagtgggagctaccccatttgactactggggccagggaaccctggtcaccgtctcctca

SEQ ID NO: 3466 - protein, 121 aa, Artificial Sequence
  synthetic
EVQLVESGGGVVQPGRSLRLSCAASGFTFSTYNMHWVRQAPGKGLEWVAVIWYDGGNKYYTDSVKGRFTISRDNSKNTLYLQMNSLRAEDTAVYYCARQSGIVGATPFDYWGQGTLVTVSS

SEQ ID NO: 3467 - DNA, 24 bp, Artificial Sequence
  synthetic
ggattcaccttcagtacctataac

SEQ ID NO: 3468 - protein, 8 aa, Artificial Sequence
  synthetic
GFTFSTYN

SEQ ID NO: 3469 - DNA, 24 bp, Artificial Sequence
  synthetic
atatggtatgatggaggtaataaa

SEQ ID NO: 3470 - protein, 8 aa, Artificial Sequence
  synthetic
IWYDGGNK

SEQ ID NO: 3471 - DNA, 42 bp, Artificial Sequence
  synthetic
gcgagacaatccggtatagtgggagctaccccatttgactac

SEQ ID NO: 3472 - protein, 14 aa, Artificial Sequence
  synthetic
ARQSGIVGATPFDY

SEQ ID NO: 3473 - DNA, 324 bp, Artificial Sequence
  synthetic
gacatcctgatgacccagtctccatcctccctgtctgcatctgtaggagacagagtcaccatcacttgccgggcaagtcagagcattagcaggtatttaaattggtatcagcagaaaccagggaaagcccctaagttcctgatctatgctgcatccagtttgcaaagtggggtcccatcaaggttcagtggcagtggatctgggacagatttcactctcaccatcggcagtctgcaacctgaagattttgcaacttactactgtcaacagacttacagtaccccattcattttcggccctgggaccaaggtggagatcaaacga

SEQ ID NO: 3474 - protein, 108 aa, Artificial Sequence
  synthetic
DILMTQSPSSLSASVGDRVTITCRASQSISRYLNWYQQKPGKAPKFLIYAASSLQSGVPSRFSGSGSGTDFTLTIGSLQPEDFATYYCQQTYSTPFIFGPGTKVEIKR

SEQ ID NO: 3475 - DNA, 18 bp, Artificial Sequence
  synthetic
cagagcattagcaggtat

SEQ ID NO: 3476 - protein, 6 aa, Artificial Sequence
  synthetic
QSISRY

SEQ ID NO: 3477 - DNA, 9 bp, Artificial Sequence
  synthetic
gctgcatcc

SEQ ID NO: 3478 - protein, 3 aa, Artificial Sequence
  synthetic
AAS

SEQ ID NO: 3479 - DNA, 27 bp, Artificial Sequence
  synthetic
caacagacttacagtaccccattcatt

SEQ ID NO: 3480 - protein, 9 aa, Artificial Sequence
  synthetic
QQTYSTPFI

SEQ ID NO: 3481 - DNA, 363 bp, Artificial Sequence; identical to SEQ ID NO: 3465
  synthetic

SEQ ID NO: 3482 - protein, 121 aa, Artificial Sequence; identical to SEQ ID NO: 3466
  synthetic

SEQ ID NO: 3483 - DNA, 24 bp, Artificial Sequence
  synthetic
ggattcaccttcagtacctataac

SEQ ID NO: 3484 - protein, 8 aa, Artificial Sequence
  synthetic
GFTFSTYN

SEQ ID NO: 3485 - DNA, 24 bp, Artificial Sequence
  synthetic
atatggtatgatggaggtaataaa

SEQ ID NO: 3486 - protein, 8 aa, Artificial Sequence
  synthetic
IWYDGGNK

SEQ ID NO: 3487 - DNA, 42 bp, Artificial Sequence; identical to SEQ ID NO: 3471
  synthetic

SEQ ID NO: 3488 - protein, 14 aa, Artificial Sequence
  synthetic
ARQSGIVGATPFDY

SEQ ID NO: 3489 - DNA, 324 bp, Artificial Sequence; identical to SEQ ID NO: 3473
  synthetic

SEQ ID NO: 3490 - protein, 108 aa, Artificial Sequence; identical to SEQ ID NO: 3474
  synthetic

SEQ ID NO: 3491 - DNA, 18 bp, Artificial Sequence
  synthetic
cagagcattagcaggtat

SEQ ID NO: 3492 - protein, 6 aa, Artificial Sequence
  synthetic
QSISRY

SEQ ID NO: 3493 - DNA, 9 bp, Artificial Sequence
  synthetic
gctgcatcc

SEQ ID NO: 3494 - protein, 3 aa, Artificial Sequence
  synthetic
AAS

SEQ ID NO: 3495 - DNA, 27 bp, Artificial Sequence
  synthetic
caacagacttacagtaccccattcatt

SEQ ID NO: 3496 - protein, 9 aa, Artificial Sequence
  synthetic
QQTYSTPFI

SEQ ID NO: 3497 - DNA, 363 bp, Artificial Sequence
  synthetic
caggtgcagctggtgcagtggggcgcaggactgttgaagccttcggagaccctgtccctcacctgcgctgtctatggtgggtccctcagtggttactactggagctggatccgccagtccccaggaaagggactggcgtggattgcggaaatcgatcatactggaagcaccaactacaatccgtccctcaagagtcgagtcaccatatcagtagacacgtccaagaaccagttctccctgaggctgagttcagtgaccgccgcggacacggctgtgtattactgtgcgagaggctctcgtataacagatcgagactggtacttcggtctctggggccgtggctccctggtcaccgtctcctca

SEQ ID NO: 3498 - protein, 121 aa, Artificial Sequence
  synthetic
QVQLVQWGAGLLKPSETLSLTCAVYGGSLSGYYWSWIRQSPGKGLAWIAEIDHTGSTNYNPSLKSRVTISVDTSKNQFSLRLSSVTAADTAVYYCARGSRITDRDWYFGLWGRGSLVTVSS

SEQ ID NO: 3499 - DNA, 24 bp, Artificial Sequence
  synthetic
ggtgggtccctcagtggttactac

SEQ ID NO: 3500 - protein, 8 aa, Artificial Sequence
  synthetic
GGSLSGYY

SEQ ID NO: 3501 - DNA, 21 bp, Artificial Sequence
  synthetic
atcgatcatactggaagcacc

SEQ ID NO: 3502 - protein, 7 aa, Artificial Sequence
  synthetic
IDHTGST

SEQ ID NO: 3503 - DNA, 45 bp, Artificial Sequence
  synthetic
gcgagaggctctcgtataacagatcgagactggtacttcggtctc

SEQ ID NO: 3504 - protein, 15 aa, Artificial Sequence
  synthetic
ARGSRITDRDWYFGL

SEQ ID NO: 3505 - DNA, 324 bp, Artificial Sequence
  synthetic
gacatcgtgatgacccagtctgcagacaccctgtctgtgtctccaggggaaagagccaccctctcctgcagggccagtcagactgttagcagccacttagcctggtaccagcagaaacctggccagtctcccaggctcctcctctattctggatccaccagggccactggtatcccagccaggttcagtggcagtgggtctgggacagagttcactctcatcatcagtggcctgcagtctgaagattttgcagtttattactgtcagcaatacaatgactggccgtacacttttggccaggggaccaaggtggagatcaaacga

SEQ ID NO: 3506 - protein, 108 aa, Artificial Sequence
  synthetic
DIVMTQSADTLSVSPGERATLSCRASQTVSSHLAWYQQKPGQSPRLLLYSGSTRATGIPARFSGSGSGTEFTLIISGLQSEDFAVYYCQQYNDWPYTFGQGTKVEIKR

SEQ ID NO: 3507 - DNA, 18 bp, Artificial Sequence
  synthetic
cagactgttagcagccac

SEQ ID NO: 3508 - protein, 6 aa, Artificial Sequence
  synthetic
QTVSSH

SEQ ID NO: 3509 - DNA, 9 bp, Artificial Sequence
  synthetic
tctggatcc

SEQ ID NO: 3510 - protein, 3 aa, Artificial Sequence
  synthetic
SGS

SEQ ID NO: 3511 - DNA, 27 bp, Artificial Sequence
  synthetic
cagcaatacaatgactggccgtacact

SEQ ID NO: 3512 - protein, 9 aa, Artificial Sequence
  synthetic
QQYNDWPYT

SEQ ID NO: 3513 - DNA, 363 bp, Artificial Sequence
  synthetic
gaggtgcagctggtggagtctgggggaggcgtggtccagcctgggaggtccctgagactctcctgtgcagcgtctggattcaccttcagtagctatggcatgcactgggtccggcaggctccaggcaaggggctggagtgggtggcagttataaggtatgatggaagtaaaaaagactatgtagacttcgtgaagggccgattcaccatctccagagacaattccaagaacacgctgtatctgcaaatgaacagcctgagagccgaggacacggctgtgtattactgtgcgagacaatccggaatagtgggagccaccccatttgactactggggccagggaaccatggtcaccgtctcctca

SEQ ID NO: 3514 - protein, 121 aa, Artificial Sequence
  synthetic
EVQLVESGGGVVQPGRSLRLSCAASGFTFSSYGMHWVRQAPGKGLEWVAVIRYDGSKKDYVDFVKGRFTISRDNSKNTLYLQMNSLRAEDTAVYYCARQSGIVGATPFDYWGQGTMVTVSS

SEQ ID NO: 3515 - DNA, 24 bp, Artificial Sequence
  synthetic
ggattcaccttcagtagctatggc

SEQ ID NO: 3516 - protein, 8 aa, Artificial Sequence
  synthetic
GFTFSSYG

SEQ ID NO: 3517 - DNA, 24 bp, Artificial Sequence
  synthetic
ataaggtatgatggaagtaaaaaa

SEQ ID NO: 3518 - protein, 8 aa, Artificial Sequence
  synthetic
IRYDGSKK

SEQ ID NO: 3519 - DNA, 42 bp, Artificial Sequence
  synthetic
gcgagacaatccggaatagtgggagccaccccatttgactac

SEQ ID NO: 3520 - protein, 14 aa, Artificial Sequence
  synthetic
ARQSGIVGATPFDY

SEQ ID NO: 3521 - DNA, 324 bp, Artificial Sequence
  synthetic
gacatcctgatgacccagtctccatcctccctgtctgcatctgtaggagacagagtcaccatcacttgccgggcaagtcagagcattagcaggtatttaaattggtatcagcagaaaccagggaaagcccctaacctcctgatctatgctgcatccagtttgcaaagtggggtcccatcaaggttcagtggcagtggatctgggacagatttcactctcatcatcagcagtctgcaacctgaagattttgcaacttactactgtcaacagagttacagtatcccattcattttcggccctgggaccaaggtggagatcaaacga

SEQ ID NO: 3522 - protein, 108 aa, Artificial Sequence
  synthetic
DILMTQSPSSLSASVGDRVTITCRASQSISRYLNWYQQKPGKAPNLLIYAASSLQSGVPSRFSGSGSGTDFTLIISSLQPEDFATYYCQQSYSIPFIFGPGTKVEIKR

SEQ ID NO: 3523 - DNA, 18 bp, Artificial Sequence
  synthetic
cagagcattagcaggtat

SEQ ID NO: 3524 - protein, 6 aa, Artificial Sequence
  synthetic
QSISRY

SEQ ID NO: 3525 - DNA, 9 bp, Artificial Sequence
  synthetic
gctgcatcc

SEQ ID NO: 3526 - protein, 3 aa, Artificial Sequence
  synthetic
AAS

SEQ ID NO: 3527 - DNA, 27 bp, Artificial Sequence
  synthetic
caacagagttacagtatcccattcatt

SEQ ID NO: 3528 - protein, 9 aa, Artificial Sequence
  synthetic
QQSYSIPFI

SEQ ID NO: 3529 - DNA, 363 bp, Artificial Sequence
  synthetic
caggtgcagctggtggagtctgggggaggcgtggtccagcctgggaggtccctgagactctcctgtgcagcgtctggattcaccttcagtagctatggcatgcactgggtccggcaggctccaggcaaggggctggagtgggtggcagttataaggtatgatggaagtaaaaaagactatgtagacttcgtgaagggccgattcaccatctccagagacaattccaagaacacgctgtatctgcaaatgaacagcctgagagccgaggacacggctgtgtattactgtgcgagacaatccggaatagtgggagccaccccatttgactactggggccagggaaccctggtcaccgtctcctca

SEQ ID NO: 3530 - protein, 121 aa, Artificial Sequence
  synthetic
QVQLVESGGGVVQPGRSLRLSCAASGFTFSSYGMHWVRQAPGKGLEWVAVIRYDGSKKDYVDFVKGRFTISRDNSKNTLYLQMNSLRAEDTAVYYCARQSGIVGATPFDYWGQGTLVTVSS

SEQ ID NO: 3531 - DNA, 24 bp, Artificial Sequence
  synthetic
ggattcaccttcagtagctatggc

SEQ ID NO: 3532 - protein, 8 aa, Artificial Sequence
  synthetic
GFTFSSYG

SEQ ID NO: 3533 - DNA, 24 bp, Artificial Sequence
  synthetic
ataaggtatgatggaagtaaaaaa

SEQ ID NO: 3534 - protein, 8 aa, Artificial Sequence
  synthetic
IRYDGSKK

SEQ ID NO: 3535 - DNA, 42 bp, Artificial Sequence; identical to SEQ ID NO: 3519
  synthetic

SEQ ID NO: 3536 - protein, 14 aa, Artificial Sequence
  synthetic
ARQSGIVGATPFDY

SEQ ID NO: 3537 - DNA, 324 bp, Artificial Sequence; identical to SEQ ID NO: 3521
  synthetic

SEQ ID NO: 3538 - protein, 108 aa, Artificial Sequence; identical to SEQ ID NO: 3522
  synthetic

SEQ ID NO: 3539 - DNA, 18 bp, Artificial Sequence
  synthetic
cagagcattagcaggtat

SEQ ID NO: 3540 - protein, 6 aa, Artificial Sequence
  synthetic
QSISRY

SEQ ID NO: 3541 - DNA, 9 bp, Artificial Sequence
  synthetic
gctgcatcc

SEQ ID NO: 3542 - protein, 3 aa, Artificial Sequence
  synthetic
AAS

SEQ ID NO: 3543 - DNA, 27 bp, Artificial Sequence
  synthetic
caacagagttacagtatcccattcatt

SEQ ID NO: 3544 - protein, 9 aa, Artificial Sequence
  synthetic
QQSYSIPFI

SEQ ID NO: 3545 - DNA, 381 bp, Artificial Sequence
  synthetic
gaggtgcagctggtggagtctgggggaggcgttatacagcggggggggtccctgagactctcctgtgcagcctctggattcacctttgatgattatgccatgcactgggtccgtcaagttccagggaagggtctggagtgggtctctcttattagttgggatggtggtagaacatactatgcagactctgtgaagggccgattcaccatctccagagacaacagcaaaaagtccctgtatctgcaaatgagcagtccgacaactgaggacaccgccttgtattactgtgcaaaagagatatccccttctacagatccttattactactactatttcggtatggacgtctggggccaagggaccacggtcaccgtctcctca

SEQ ID NO: 3546 - protein, 127 aa, Artificial Sequence
  synthetic
EVQLVESGGGVIQRGGSLRLSCAASGFTFDDYAMHWVRQVPGKGLEWVSLISWDGGRTYYADSVKGRFTISRDNSKKSLYLQMSSPTTEDTALYYCAKEISPSTDPYYYYYFGMDVWGQGTTVTVSS

SEQ ID NO: 3547 - DNA, 24 bp, Artificial Sequence
  synthetic
ggattcacctttgatgattatgcc

SEQ ID NO: 3548 - protein, 8 aa, Artificial Sequence
  synthetic
GFTFDDYA

SEQ ID NO: 3549 - DNA, 24 bp, Artificial Sequence
  synthetic
attagttgggatggtggtagaaca

SEQ ID NO: 3550 - protein, 8 aa, Artificial Sequence
  synthetic
ISWDGGRT

SEQ ID NO: 3551 - DNA, 60 bp, Artificial Sequence
  synthetic
gcaaaagagatatccccttctacagatccttattactactactatttcggtatggacgtc

SEQ ID NO: 3552 - protein, 20 aa, Artificial Sequence
  synthetic
AKEISPSTDPYYYYYFGMDV

SEQ ID NO: 3553 - DNA, 324 bp, Artificial Sequence
  synthetic
gacatcgtgatgacccagtctccaggcaccctgtctttgtctccaggggaaagagccaccctctcctgcaggaccagtcagattattaatgacaactacttcgcctggtatcagcagaaacctggccaggctcccaggctcctcatctatgctacatccagcagggccactggcatcccagacaggttcagtggcagtgggtctgggacagacttcactctcaccatcagcagactggagcctgaagattttgcggtgtattactgtcagcattatggtacctcacctccttttggccaggggaccaaggtggagatcaaacga

SEQ ID NO: 3554 - protein, 108 aa, Artificial Sequence
  synthetic
DIVMTQSPGTLSLSPGERATLSCRTSQIINDNYFAWYQQKPGQAPRLLIYATSSRATGIPDRFSGSGSGTDFTLTISRLEPEDFAVYYCQHYGTSPPFGQGTKVEIKR

SEQ ID NO: 3555 - DNA, 21 bp, Artificial Sequence
  synthetic
cagattattaatgacaactac

SEQ ID NO: 3556 - protein, 7 aa, Artificial Sequence
  synthetic
QIINDNY

SEQ ID NO: 3557 - DNA, 9 bp, Artificial Sequence
  synthetic
gctacatcc

SEQ ID NO: 3558 - protein, 3 aa, Artificial Sequence
  synthetic
ATS

SEQ ID NO: 3559 - DNA, 24 bp, Artificial Sequence
  synthetic
cagcattatggtacctcacctcct

SEQ ID NO: 3560 - protein, 8 aa, Artificial Sequence
  synthetic
QHYGTSPP

SEQ ID NO: 3561 - DNA, 348 bp, Artificial Sequence
  synthetic
gaggtgcagctggtggagtcgggcccaggactggtgaagccttcggagaccctgtccctcacctgcactgtctctggtggctccatcagtgattactactggagctggatccggcagcccccagggaagggactggaatggattggatatatctattacactgggagcaccaaccacaacccctccctcaagagtcggttcaccatatcattggacacgtccaggaaccagttctccctgaagctgagctctgtgaccgccgcagacacggccgtgtatttctgtgcgcgacaaaacggtgactcttttgactactggggccagggaaccctggtcaccgtctcctca

SEQ ID NO: 3562 - protein, 116 aa, Artificial Sequence
  synthetic
EVQLVESGPGLVKPSETLSLTCTVSGGSISDYYWSWIRQPPGKGLEWIGYIYYTGSTNHNPSLKSRFTISLDTSRNQFSLKLSSVTAADTAVYFCARQNGDSFDYWGQGTLVTVSS

SEQ ID NO: 3563 - DNA, 24 bp, Artificial Sequence
  synthetic
ggtggctccatcagtgattactac

SEQ ID NO: 3564 - protein, 8 aa, Artificial Sequence
  synthetic
GGSISDYY

SEQ ID NO: 3565 - DNA, 21 bp, Artificial Sequence
  synthetic
atctattacactgggagcacc

SEQ ID NO: 3566 - protein, 7 aa, Artificial Sequence
  synthetic
IYYTGST

SEQ ID NO: 3567 - DNA, 30 bp, Artificial Sequence
  synthetic
gcgcgacaaaacggtgactcttttgactac

SEQ ID NO: 3568 - protein, 10 aa, Artificial Sequence
  synthetic
ARQNGDSFDY

SEQ ID NO: 3569 - DNA, 324 bp, Artificial Sequence
  synthetic
gacatcctgatgacccagtctccgtcctccctgtctgcatctgtgggagacagagtcaccatcacttgccgggcaagccagagcattgccaactatttaaattggtatcgccagcaaccaggtagagcccctaacctcctgatctatgctgcatccagattgcaacgtggggtcccatcaaggttcagtggcagtggatctgggacatatttcactctcaccatcagcaatctgcaacctgaagattttgcaacttactactgtcaacagtgttacactaccccatactcttttggccaggggaccaaggtggagatcaaacga

SEQ ID NO: 3570 - protein, 108 aa, Artificial Sequence
  synthetic
DILMTQSPSSLSASVGDRVTITCRASQSIANYLNWYRQQPGRAPNLLIYAASRLQRGVPSRFSGSGSGTYFTLTISNLQPEDFATYYCQQCYTTPYSFGQGTKVEIKR

SEQ ID NO: 3571 - DNA, 18 bp, Artificial Sequence
  synthetic
cagagcattgccaactat

SEQ ID NO: 3572 - protein, 6 aa, Artificial Sequence
  synthetic
QSIANY

SEQ ID NO: 3573 - DNA, 9 bp, Artificial Sequence
  synthetic
gctgcatcc

SEQ ID NO: 3574 - protein, 3 aa, Artificial Sequence
  synthetic
AAS

SEQ ID NO: 3575 - DNA, 27 bp, Artificial Sequence
  synthetic
caacagtgttacactaccccatactct

SEQ ID NO: 3576 - protein, 9 aa, Artificial Sequence
  synthetic
QQCYTTPYS

SEQ ID NO: 3577 - DNA, 381 bp, Artificial Sequence
  synthetic
caggtgcagctggtggagtcggggggaggcgtagtacagcctggggggtccctgagactctcctgtgcagcctctggattcacctttgatgattatgccatgcactgggtccgtcaagctccagggaagggtctggagtgggtctctctcattaattgggatggacataatacatattatgcagactctgtgaagggccgattcaccatctccagagacaacagcaaaaactccctgtggctgcaaatgaacagtctgagaactgaagacagcgccttgtattactgtgcaaaagagatttccccttctacagatccttattacttctactacttcggtatggacgtctggggccaagggaccacggtcaccgtctcctca

SEQ ID NO: 3578 - protein, 127 aa, Artificial Sequence
  synthetic
QVQLVESGGGVVQPGGSLRLSCAASGFTFDDYAMHWVRQAPGKGLEWVSLINWDGHNTYYADSVKGRFTISRDNSKNSLWLQMNSLRTEDSALYYCAKEISPSTDPYYFYYFGMDVWGQGTTVTVSS

SEQ ID NO: 3579 - DNA, 24 bp, Artificial Sequence
  synthetic
ggattcacctttgatgattatgcc

SEQ ID NO: 3580 - protein, 8 aa, Artificial Sequence
  synthetic
GFTFDDYA

SEQ ID NO: 3581 - DNA, 24 bp, Artificial Sequence
  synthetic
attaattgggatggacataataca

SEQ ID NO: 3582 - protein, 8 aa, Artificial Sequence
  synthetic
INWDGHNT

SEQ ID NO: 3583 - DNA, 60 bp, Artificial Sequence
  synthetic
gcaaaagagatttccccttctacagatccttattacttctactacttcggtatggacgtc

SEQ ID NO: 3584 - protein, 20 aa, Artificial Sequence
  synthetic
AKEISPSTDPYYFYYFGMDV

SEQ ID NO: 3585 - DNA, 324 bp, Artificial Sequence
  synthetic
gacatcgtgatgacccagtctccaggcaccctgtctttgtctccaggggaaagagccaccctctcctgcagggccagtcagagtgtaagcagcagctacttagcctggtaccagcagaaacctggccaggctcccaggctcctcatctatgctacatccagtagggccactggcatcccagacaggttcagtggcagtgggtctgggacagacttcactctcaccatcagcagactggagcctgaagattttgcaatgtattactgtcagcactatgttggttcacctccttttggccaggggaccaaggtggagatcaaacga

SEQ ID NO: 3586 - protein, 108 aa, Artificial Sequence
  synthetic
DIVMTQSPGTLSLSPGERATLSCRASQSVSSSYLAWYQQKPGQAPRLLIYATSSRATGIPDRFSGSGSGTDFTLTISRLEPEDFAMYYCQHYVGSPPFGQGTKVEIKR

SEQ ID NO: 3587 - DNA, 21 bp, Artificial Sequence
  synthetic
cagagtgtaagcagcagctac

SEQ ID NO: 3588 - protein, 7 aa, Artificial Sequence
  synthetic
QSVSSSY

SEQ ID NO: 3589 - DNA, 9 bp, Artificial Sequence
  synthetic
gctacatcc

SEQ ID NO: 3590 - protein, 3 aa, Artificial Sequence
  synthetic
ATS

SEQ ID NO: 3591 - DNA, 24 bp, Artificial Sequence
  synthetic
cagcactatgttggttcacctcct

SEQ ID NO: 3592 - protein, 8 aa, Artificial Sequence
  synthetic
QHYVGSPP

SEQ ID NO: 3593 - DNA, 354 bp, Artificial Sequence
  synthetic
gaggtgcagctggtggagtcgggcccaggactggtgaagccttcggagaccctgtccctcacctgcactgtctctggtggctccatcagtggttattattggagttggatccggcagcccccagggaagggactggagtggattggttacatctattacactgggagcaccaattacaatccctccctcgagagtcgagtcaccatatcagtggacacgtccaagaatcagttctccctgaagttgaagtctgtgactgccgcagacacggccgtgtattactgtgcgagagatgacgcggactacaacggtatggacgtctggggccaagggaccatggtcaccgtctcctca

SEQ ID NO: 3594 - protein, 118 aa, Artificial Sequence
  synthetic
EVQLVESGPGLVKPSETLSLTCTVSGGSISGYYWSWIRQPPGKGLEWIGYIYYTGSTNYNPSLESRVTISVDTSKNQFSLKLKSVTAADTAVYYCARDDADYNGMDVWGQGTMVTVSS

SEQ ID NO: 3595 - DNA, 24 bp, Artificial Sequence
  synthetic
ggtggctccatcagtggttattat

SEQ ID NO: 3596 - protein, 8 aa, Artificial Sequence
  synthetic
GGSISGYY

SEQ ID NO: 3597 - DNA, 21 bp, Artificial Sequence
  synthetic
atctattacactgggagcacc

SEQ ID NO: 3598 - protein, 7 aa, Artificial Sequence
  synthetic
IYYTGST

SEQ ID NO: 3599 - DNA, 36 bp, Artificial Sequence
  synthetic
gcgagagatgacgcggactacaacggtatggacgtc

SEQ ID NO: 3600 - protein, 12 aa, Artificial Sequence
  synthetic
ARDDADYNGMDV

SEQ ID NO: 3601 - DNA, 339 bp, Artificial Sequence
  synthetic
gacatcgtgatgacccagtctccactctccctgcccgtcacccttggacagccggcctccatctcctgcaggtctagtcaaagtctcatatacaatgatggaaaaatttatttgaattggtttcagcagaggccaggccaatctccaaggcgcctgatttataaggtttctaaccgggactctggggtcccagacagattcaggggcagtgggtcaggcactgaattcacactgaaaatcagcagggtggaggctgaggatgttggggtttattattgcatgcaaagtacacactggccgctcactttcggcggagggaccaaggtggagatcaaacga

SEQ ID NO: 3602 - protein, 113 aa, Artificial Sequence
  synthetic
DIVMTQSPLSLPVTLGQPASISCRSSQSLIYNDGKIYLNWFQQRPGQSPRRLIYKVSNRDSGVPDRFRGSGSGTEFTLKISRVEAEDVGVYYCMQSTHWPLTFGGGTKVEIKR

SEQ ID NO: 3603 - DNA, 33 bp, Artificial Sequence
  synthetic
caaagtctcatatacaatgatggaaaaatttat

SEQ ID NO: 3604 - protein, 11 aa, Artificial Sequence
  synthetic
QSLIYNDGKIY

SEQ ID NO: 3605 - DNA, 9 bp, Artificial Sequence
  synthetic
aaggtttct

SEQ ID NO: 3606 - protein, 3 aa, Artificial Sequence
  synthetic
KVS

SEQ ID NO: 3607 - DNA, 27 bp, Artificial Sequence
  synthetic
atgcaaagtacacactggccgctcact

SEQ ID NO: 3608 - protein, 9 aa, Artificial Sequence
  synthetic
MQSTHWPLT

SEQ ID NO: 3609 - DNA, 357 bp, Artificial Sequence
  synthetic
gaggtgcagctggtggagtctgggggagacttggtacagcctggcaggtccctgagactctcctgtgcagcctctggattcacctttggtgattatgccatgcactgggtccggcaaggtccagggaagggcctggagtgggtctcaagtattagttggagtggtgagaacgtcgcctatgcagactctgtgaagggccgattcaccatctccagagacaacgccaagaactccctgtatctgcaaatgaacagtctgagacctgaggacacggccctctactattgtgcaaaagatatatgggactacttcggtatggacgtctggggccaagggaccacggtcaccgtctcctca

SEQ ID NO: 3610 - protein, 119 aa, Artificial Sequence
  synthetic
EVQLVESGGDLVQPGRSLRLSCAASGFTFGDYAMHWVRQGPGKGLEWVSSISWSGENVAYADSVKGRFTISRDNAKNSLYLQMNSLRPEDTALYYCAKDIWDYFGMDVWGQGTTVTVSS

SEQ ID NO: 3611 - DNA, 24 bp, Artificial Sequence
  synthetic
ggattcacctttggtgattatgcc

SEQ ID NO: 3612 - protein, 8 aa, Artificial Sequence
  synthetic
GFTFGDYA

SEQ ID NO: 3613 - DNA, 24 bp, Artificial Sequence
  synthetic
attagttggagtggtgagaacgtc

SEQ ID NO: 3614 - protein, 8 aa, Artificial Sequence
  synthetic
ISWSGENV

SEQ ID NO: 3615 - DNA, 36 bp, Artificial Sequence
  synthetic
gcaaaagatatatgggactacttcggtatggacgtc

SEQ ID NO: 3616 - protein, 12 aa, Artificial Sequence
  synthetic
AKDIWDYFGMDV

SEQ ID NO: 3617 - DNA, 324 bp, Artificial Sequence
  synthetic
gacatcgtgatgacccagtctccaggcaccctgtctttgtctccaggggaaagagccaccctctcctgcagggccagtcagaaaattaacagcaattacttagtctggtaccagcagaaacctggccaggcccccaggctcctcatctatggtgcatccaacagggccactggcatcccagacaggttcagtggcggtgggtctgggacagacttcattctcactatcagcagactggagcctgaagattttgtagtgtattactgtcaccactatggtacctcgtacacttttgcccaggggaccaaggtggagatcaaacga

SEQ ID NO: 3618 - protein, 108 aa, Artificial Sequence
  synthetic
DIVMTQSPGTLSLSPGERATLSCRASQKINSNYLVWYQQKPGQAPRLLIYGASNRATGIPDRFSGGGSGTDFILTISRLEPEDFVVYYCHHYGTSYTFAQGTKVEIKR

SEQ ID NO: 3619 - DNA, 21 bp, Artificial Sequence
  synthetic
cagaaaattaacagcaattac

SEQ ID NO: 3620 - protein, 7 aa, Artificial Sequence
  synthetic
QKINSNY

SEQ ID NO: 3621 - DNA, 9 bp, Artificial Sequence
  synthetic
ggtgcatcc

SEQ ID NO: 3622 - protein, 3 aa, Artificial Sequence
  synthetic
GAS

SEQ ID NO: 3623 - DNA, 24 bp, Artificial Sequence
  synthetic
caccactatggtacctcgtacact

SEQ ID NO: 3624 - protein, 8 aa, Artificial Sequence
  synthetic
HHYGTSYT

SEQ ID NO: 3625 - DNA, 348 bp, Artificial Sequence
  synthetic
caggtgcagctggtggagtcgggcccaggactggtgaagccttcggagaccctgtccctcacctgcactgtctctggtggctccatcagtgattactactggagctggatccggcagcccccaggaaagggactggagtggattggatatatctattacactgggagcaccaactacaacccctccctcaagagtcggttcaccatatcattggacacgtccaggaaccagttctccctgaagctgagctctgtgaccgccgcagacacggccgtgtatttctgtgcgagacaaaacggtgactcttttgactactggggccagggaaccctggtcaccgtctcctca

SEQ ID NO: 3626 - protein, 116 aa, Artificial Sequence
  synthetic
QVQLVESGPGLVKPSETLSLTCTVSGGSISDYYWSWIRQPPGKGLEWIGYIYYTGSTNYNPSLKSRFTISLDTSRNQFSLKLSSVTAADTAVYFCARQNGDSFDYWGQGTLVTVSS

SEQ ID NO: 3627 - DNA, 24 bp, Artificial Sequence
  synthetic
ggtggctccatcagtgattactac

SEQ ID NO: 3628 - protein, 8 aa, Artificial Sequence
  synthetic
GGSISDYY

SEQ ID NO: 3629 - DNA, 21 bp, Artificial Sequence
  synthetic
atctattacactgggagcacc

SEQ ID NO: 3630 - protein, 7 aa, Artificial Sequence
  synthetic
IYYTGST

SEQ ID NO: 3631 - DNA, 30 bp, Artificial Sequence
  synthetic
gcgagacaaaacggtgactcttttgactac

SEQ ID NO: 3632 - protein, 10 aa, Artificial Sequence
  synthetic
ARQNGDSFDY

SEQ ID NO: 3633 - DNA, 324 bp, Artificial Sequence
  synthetic
gacatccagatgacccagtctccgtcctccctgtctgcatctgtgggagacagagtcaccatcacttgccgggcaagccagagtattagtagctatttaaattggtatcggcagcaaccagggagagcccctaacctcctgatctatgctgcatccagattgcaacgtggggtcccatcaaggttcagtggcagtggatctgggacatatttcactctcaccatcagcagtctgcaacctgaagattttgcaacttactactgtcaacagtgttacagtaccccgtactcttttggccaggggaccaaggtggagatcaaacga

SEQ ID NO: 3634 - protein, 108 aa, Artificial Sequence
  synthetic
DIQMTQSPSSLSASVGDRVTITCRASQSISSYLNWYRQQPGRAPNLLIYAASRLQRGVPSRFSGSGSGTYFTLTISSLQPEDFATYYCQQCYSTPYSFGQGTKVEIKR

SEQ ID NO: 3635 - DNA, 18 bp, Artificial Sequence
  synthetic
cagagtattagtagctat

SEQ ID NO: 3636 - protein, 6 aa, Artificial Sequence
  synthetic
QSISSY

SEQ ID NO: 3637 - DNA, 9 bp, Artificial Sequence
  synthetic
gctgcatcc

SEQ ID NO: 3638 - protein, 3 aa, Artificial Sequence
  synthetic
AAS

SEQ ID NO: 3639 - DNA, 27 bp, Artificial Sequence
  synthetic
caacagtgttacagtaccccgtactct

SEQ ID NO: 3640 - protein, 9 aa, Artificial Sequence
  synthetic
QQCYSTPYS

SEQ ID NO: 3641 - DNA, 381 bp, Artificial Sequence
  synthetic
gaggtgcagctggtggagtctgggggaggcgttatacagcggggggggtccctgagactctcctgtgcagcctctggattcacctttgatgattatgccatgcactgggtccgtcaagttccagggaagggtctggagtgggtctctcttattagttgggatggtggtagcacatactatgcagactctgtgaagggccgattcaccatctccagagacaacagcaaaaagtccctgtatctgcaaatgagcagtccgacaactgaggacaccgccttgtattactgtgcaaaagagatatccccttctacagatccttattactactactatttcggtatggacgtctggggccaagggaccacggtcaccgtctcctca

SEQ ID NO: 3642 - protein, 127 aa, Artificial Sequence
  synthetic
EVQLVESGGGVIQRGGSLRLSCAASGFTFDDYAMHWVRQVPGKGLEWVSLISWDGGSTYYADSVKGRFTISRDNSKKSLYLQMSSPTTEDTALYYCAKEISPSTDPYYYYYFGMDVWGQGTTVTVSS

SEQ ID NO: 3643 - DNA, 24 bp, Artificial Sequence
  synthetic
ggattcacctttgatgattatgcc

SEQ ID NO: 3644 - protein, 8 aa, Artificial Sequence
  synthetic
GFTFDDYA

SEQ ID NO: 3645 - DNA, 24 bp, Artificial Sequence
  synthetic
attagttgggatggtggtagcaca

SEQ ID NO: 3646 - protein, 8 aa, Artificial Sequence
  synthetic
ISWDGGST

SEQ ID NO: 3647 - DNA, 60 bp, Artificial Sequence; identical to SEQ ID NO: 3551
  synthetic

SEQ ID NO: 3648 - protein, 20 aa, Artificial Sequence
  synthetic
AKEISPSTDPYYYYYFGMDV

SEQ ID NO: 3649 - DNA, 324 bp, Artificial Sequence
  synthetic
gacatcgtgatgacccagtctccaggcaccctgtctttgtctccaggggaaagagccaccctctcctgcaggaccagtcagattattaatggcaactacttcgcctggtatcagcagaaacctggccaggctcccaggctcctcatctatgctacatccagcagggccactggcatcccagacaggttcagtggcagtgggtctgggacagacttcactctcaccatcagcagactggagcctgaagattttgcagtgtattactgtcagcattatggtacctcacctccttttggccaggggaccaaggtggagatcaaacga

SEQ ID NO: 3650 - protein, 108 aa, Artificial Sequence
  synthetic
DIVMTQSPGTLSLSPGERATLSCRTSQIINGNYFAWYQQKPGQAPRLLIYATSSRATGIPDRFSGSGSGTDFTLTISRLEPEDFAVYYCQHYGTSPPFGQGTKVEIKR

SEQ ID NO: 3651 - DNA, 21 bp, Artificial Sequence
  synthetic
cagattattaatggcaactac

SEQ ID NO: 3652 - protein, 7 aa, Artificial Sequence
  synthetic
QIINGNY

SEQ ID NO: 3653 - DNA, 9 bp, Artificial Sequence
  synthetic
gctacatcc

SEQ ID NO: 3654 - protein, 3 aa, Artificial Sequence
  synthetic
ATS

SEQ ID NO: 3655 - DNA, 24 bp, Artificial Sequence
  synthetic
cagcattatggtacctcacctcct

SEQ ID NO: 3656 - protein, 8 aa, Artificial Sequence
  synthetic
QHYGTSPP

SEQ ID NO: 3657 - DNA, 366 bp, Artificial Sequence
  synthetic
gaggtgcagctggtggagtctggaacagaggtgaaaaagcccggggagtctctgaagatctcctgtaagggttctggatacacctttaccaggaactggatcggctgggtgcgccagatgcccgggaaaggcctggagtggatgggcatcatctatcctcgtgactcagataccagatacagtccgtccttccaaggccaggtcaccatgttagtcgacaagtcaagtagtaccgcctacctgcagtggagcagcctgaaggcctcggacaccgccgtgtattactgtgcgagactcggggacctatataactactactatggtatggacgtctggggccaagggaccacggtcaccgtctcctca

SEQ ID NO: 3658 - protein, 122 aa, Artificial Sequence
  synthetic
EVQLVESGTEVKKPGESLKISCKGSGYTFTRNWIGWVRQMPGKGLEWMGIIYPRDSDTRYSPSFQGQVTMLVDKSSSTAYLQWSSLKASDTAVYYCARLGDLYNYYYGMDVWGQGTTVTVSS

SEQ ID NO: 3659 - DNA, 24 bp, Artificial Sequence
  synthetic
ggatacacctttaccaggaactgg

SEQ ID NO: 3660 - protein, 8 aa, Artificial Sequence
  synthetic
GYTFTRNW

SEQ ID NO: 3661 - DNA, 24 bp, Artificial Sequence
  synthetic
atctatcctcgtgactcagatacc

SEQ ID NO: 3662 - protein, 8 aa, Artificial Sequence
  synthetic
IYPRDSDT

SEQ ID NO: 3663 - DNA, 45 bp, Artificial Sequence
  synthetic
gcgagactcggggacctatataactactactatggtatggacgtc

SEQ ID NO: 3664 - protein, 15 aa, Artificial Sequence
  synthetic
ARLGDLYNYYYGMDV

SEQ ID NO: 3665 - DNA, 324 bp, Artificial Sequence
  synthetic
gacatccagatgacccagtctccatcctccctgtctgcatctgtaggagacagagtcaccatcacttgccgggcaagtcagaccattaacagctatttaaattggtatcagcagaaatcagggaaagcccctaacctcctgctctatgctgcatccagtttgcaaagtggggtcccatcaaggttcagtggcagtggatctgggacagatttcactctcaccatcagcagtctgcaacctgaagattttgcaactttctactgtcaacagagttacagtgccccgtacacttttggccaggggaccaaggtggagatcaaacga

SEQ ID NO: 3666 - protein, 108 aa, Artificial Sequence
  synthetic
DIQMTQSPSSLSASVGDRVTITCRASQTINSYLNWYQQKSGKAPNLLLYAASSLQSGVPSRFSGSGSGTDFTLTISSLQPEDFATFYCQQSYSAPYTFGQGTKVEIKR

SEQ ID NO: 3667 - DNA, 18 bp, Artificial Sequence
  synthetic
cagaccattaacagctat

SEQ ID NO: 3668 - protein, 6 aa, Artificial Sequence
  synthetic
QTINSY

SEQ ID NO: 3669 - DNA, 9 bp, Artificial Sequence
  synthetic
gctgcatcc

SEQ ID NO: 3670 - protein, 3 aa, Artificial Sequence
  synthetic
AAS

SEQ ID NO: 3671 - DNA, 27 bp, Artificial Sequence
  synthetic
caacagagttacagtgccccgtacact

SEQ ID NO: 3672 - protein, 9 aa, Artificial Sequence
  synthetic
QQSYSAPYT

SEQ ID NO: 3673 - DNA, 366 bp, Artificial Sequence
  synthetic
gaggtgcagctggtggagtctgggggaggcgtggtacagcctggggggtccctgagactctcctgtgcagcctctggattcacctttgatgattatgccatgcactgggtccgtcaagctccagggaagggtctggagtgggtctctcttattactggggatggtggtagcacatactatgcagactctgtgaagggccgattcaccatctccagagacaacagcaaaaactccctgtatctgcaaatgaacagtctgagaactgaggacaccgccttgtattactgtgcaaaagatagagctggaactaactactactacggtatggacgtctggggccaagggaccacggtcaccgtctcctca

SEQ ID NO: 3674 - protein, 122 aa, Artificial Sequence
  synthetic
EVQLVESGGGVVQPGGSLRLSCAASGFTFDDYAMHWVRQAPGKGLEWVSLITGDGGSTYYADSVKGRFTISRDNSKNSLYLQMNSLRTEDTALYYCAKDRAGTNYYYGMDVWGQGTTVTVSS

SEQ ID NO: 3675 - DNA, 24 bp, Artificial Sequence
  synthetic
ggattcacctttgatgattatgcc

SEQ ID NO: 3676 - protein, 8 aa, Artificial Sequence
  synthetic
GFTFDDYA

SEQ ID NO: 3677 - DNA, 24 bp, Artificial Sequence
  synthetic
attactggggatggtggtagcaca

SEQ ID NO: 3678 - protein, 8 aa, Artificial Sequence
  synthetic
ITGDGGST

SEQ ID NO: 3679 - DNA, 45 bp, Artificial Sequence
  synthetic
gcaaaagatagagctggaactaactactactacggtatggacgtc

SEQ ID NO: 3680 - protein, 15 aa, Artificial Sequence
  synthetic
AKDRAGTNYYYGMDV

SEQ ID NO: 3681 - DNA, 327 bp, Artificial Sequence
  synthetic
gacatcgtgatgacccagtctccaggcaccctgtctttgtctccaggggaaagagccaccctctcctgtagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcatcgatcaccttcggccaagggaccaaactggagatcaaacga

SEQ ID NO: 3682 - protein, 109 aa, Artificial Sequence
  synthetic
DIVMTQSPGTLSLSPGERATLSCRASQSVSSSYLAWYQQKPGQAPRLLIYGASSRATGIPDRFSGSGSGTDFTLTISRLEPEDFAVYYCQQYGSSSITFGQGTKLEIKR

SEQ ID NO: 3683 - DNA, 21 bp, Artificial Sequence
  synthetic
cagagtgttagcagcagctac

SEQ ID NO: 3684 - protein, 7 aa, Artificial Sequence
  synthetic
QSVSSSY

SEQ ID NO: 3685 - DNA, 9 bp, Artificial Sequence
  synthetic
ggtgcatcc

SEQ ID NO: 3686 - protein, 3 aa, Artificial Sequence
  synthetic
GAS

SEQ ID NO: 3687 - DNA, 27 bp, Artificial Sequence
  synthetic
cagcagtatggtagctcatcgatcacc

SEQ ID NO: 3688 - protein, 9 aa, Artificial Sequence
  synthetic
QQYGSSSIT

SEQ ID NO: 3689 - DNA, 381 bp, Artificial Sequence
  synthetic
gaggtgcagctggtggagtctgggggaggcgttatacagcggggggggtccctgagactctcctgtgcagcctctggattcacctttgaagattatgccatgcactgggtccgtcaagttccagggaagggtctggagtgggtctcttttattaattgggatggtggcagcacatactatgcagactctgtgaagggccgattcaccatctccagagacaacagcaaaaagtccctgtatctgcaaatgagcagtccgacaactgaggacaccgccgtgtattactgtgcaaaagagatatccccttctacagatccttattactactactatttcggtatggacgtctggggccaagggaccacggtcaccgtctcctca

SEQ ID NO: 3690 - protein, 127 aa, Artificial Sequence
  synthetic
EVQLVESGGGVIQRGGSLRLSCAASGFTFEDYAMHWVRQVPGKGLEWVSFINWDGGSTYYADSVKGRFTISRDNSKKSLYLQMSSPTTEDTAVYYCAKEISPSTDPYYYYYFGMDVWGQGTTVTVSS

SEQ ID NO: 3691 - DNA, 24 bp, Artificial Sequence
  synthetic
ggattcacctttgaagattatgcc

SEQ ID NO: 3692 - protein, 8 aa, Artificial Sequence
  synthetic
GFTFEDYA

SEQ ID NO: 3693 - DNA, 24 bp, Artificial Sequence
  synthetic
attaattgggatggtggcagcaca

SEQ ID NO: 3694 - protein, 8 aa, Artificial Sequence
  synthetic
INWDGGST

SEQ ID NO: 3695 - DNA, 60 bp, Artificial Sequence; identical to SEQ ID NO: 3551
  synthetic

SEQ ID NO: 3696 - protein, 20 aa, Artificial Sequence
  synthetic
AKEISPSTDPYYYYYFGMDV

SEQ ID NO: 3697 - DNA, 324 bp, Artificial Sequence
  synthetic
gacatcgtgatgacccagtctccaggcaccctgtctttgtctccaggggaaagagccaccctctcctgcaggaccagtcagattattaatgacaactacttcgcctggtatcagcagaaacctggccagcctcccaggctcctcatctatgctacatccagcagggccactggcatcccagacaggttcagtggcagtgggtctgggacagacttcactctcaccatcagcagactggagcctggtgattttgcagtgtattactgtcagcattatggtacctcacctccttttggccaggggaccaaggtggagatcaaacga

SEQ ID NO: 3698 - protein, 108 aa, Artificial Sequence
  synthetic
DIVMTQSPGTLSLSPGERATLSCRTSQIINDNYFAWYQQKPGQPPRLLIYATSSRATGIPDRFSGSGSGTDFTLTISRLEPGDFAVYYCQHYGTSPPFGQGTKVEIKR

SEQ ID NO: 3699 - DNA, 21 bp, Artificial Sequence
  synthetic
cagattattaatgacaactac

SEQ ID NO: 3700 - protein, 7 aa, Artificial Sequence
  synthetic
QIINDNY

SEQ ID NO: 3701 - DNA, 9 bp, Artificial Sequence
  synthetic
gctacatcc

SEQ ID NO: 3702 - protein, 3 aa, Artificial Sequence
  synthetic
ATS

SEQ ID NO: 3703 - DNA, 24 bp, Artificial Sequence
  synthetic
cagcattatggtacctcacctcct

SEQ ID NO: 3704 - protein, 8 aa, Artificial Sequence
  synthetic
QHYGTSPP

SEQ ID NO: 3705 - DNA, 381 bp, Artificial Sequence; identical to SEQ ID NO: 3641
  synthetic

SEQ ID NO: 3706 - protein, 127 aa, Artificial Sequence; identical to SEQ ID NO: 3642
  synthetic

SEQ ID NO: 3707 - DNA, 24 bp, Artificial Sequence
  synthetic
ggattcacctttgatgattatgcc

SEQ ID NO: 3708 - protein, 8 aa, Artificial Sequence
  synthetic
GFTFDDYA

SEQ ID NO: 3709 - DNA, 24 bp, Artificial Sequence
  synthetic
attagttgggatggtggtagcaca

SEQ ID NO: 3710 - protein, 8 aa, Artificial Sequence
  synthetic
ISWDGGST

SEQ ID NO: 3711 - DNA, 60 bp, Artificial Sequence; identical to SEQ ID NO: 3551
  synthetic

SEQ ID NO: 3712 - protein, 20 aa, Artificial Sequence
  synthetic
AKEISPSTDPYYYYYFGMDV

SEQ ID NO: 3713 - DNA, 324 bp, Artificial Sequence
  synthetic
gacatcgtgatgacccagtctccaggcaccctgtctttgtctccaggggaaagagccaccctctcctgcaggaccagtcagattattaatgacaactacttcgcctggtatcagcagaaacctggccaggctcccaggctcctcatctatgctacatccagcagggccactggcatcccagacaggttcagtggcagtgggtctgggacagacttcactctcaccatcagcagactggagcctgaagattttgcagtgtattactgtcagcattatggtacctcacctccttttggccaggggaccaaggtggagatcaaacga

SEQ ID NO: 3714 - protein, 108 aa, Artificial Sequence; identical to SEQ ID NO: 3554
  synthetic

SEQ ID NO: 3715 - DNA, 21 bp, Artificial Sequence
  synthetic
cagattattaatgacaactac

SEQ ID NO: 3716 - protein, 7 aa, Artificial Sequence
  synthetic
QIINDNY

SEQ ID NO: 3717 - DNA, 9 bp, Artificial Sequence
  synthetic
gctacatcc

SEQ ID NO: 3718 - protein, 3 aa, Artificial Sequence
  synthetic
ATS

SEQ ID NO: 3719 - DNA, 24 bp, Artificial Sequence
  synthetic
cagcattatggtacctcacctcct

SEQ ID NO: 3720 - protein, 8 aa, Artificial Sequence
  synthetic
QHYGTSPP

SEQ ID NO: 3721 - DNA, 381 bp, Artificial Sequence
  synthetic
gaggtgcagctggtggagtctgggggaggcgttatacagcggggggggtccctgagactctcctgtgcagcctctggattcacctttgatgattatgccatgcactgggtccgtcaagttccagggaagggtctggagtgggtctctcttattagtggggatggtggtagcacatactatgcagactctgtgaagggccgattcaccatctccagagacaacagcaaaaagtccctgtatctgcaaatgaacagtccgagaactgaggacaccgccttgtattactgtgcaaaagagatatccccttctacagatccttattactactactatttcggtatggacgtctggggccaagggaccacggtcaccgtctcctca

SEQ ID NO: 3722 - protein, 127 aa, Artificial Sequence
  synthetic
EVQLVESGGGVIQRGGSLRLSCAASGFTFDDYAMHWVRQVPGKGLEWVSLISGDGGSTYYADSVKGRFTISRDNSKKSLYLQMNSPRTEDTALYYCAKEISPSTDPYYYYYFGMDVWGQGTTVTVSS

SEQ ID NO: 3723 - DNA, 24 bp, Artificial Sequence
  synthetic
ggattcacctttgatgattatgcc

SEQ ID NO: 3724 - protein, 8 aa, Artificial Sequence
  synthetic
GFTFDDYA

SEQ ID NO: 3725 - DNA, 24 bp, Artificial Sequence
  synthetic
attagtggggatggtggtagcaca

SEQ ID NO: 3726 - protein, 8 aa, Artificial Sequence
  synthetic
ISGDGGST

SEQ ID NO: 3727 - DNA, 60 bp, Artificial Sequence; identical to SEQ ID NO: 3551
  synthetic

SEQ ID NO: 3728 - protein, 20 aa, Artificial Sequence
  synthetic
AKEISPSTDPYYYYYFGMDV

SEQ ID NO: 3729 - DNA, 324 bp, Artificial Sequence
  synthetic
gacatcgtgatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctcggacgttcggccaagggaccaaggtggagatcaaacga

SEQ ID NO: 3730 - protein, 108 aa, Artificial Sequence
  synthetic
DIVMTQSPSSLSASVGDRVTITCRASQGISNYLAWYQQKPGKVPKLLIYAASTLQSGVPSRFSGSGSGTDFTLTISSLQPEDVATYYCQKYNSAPRTFGQGTKVEIKR

SEQ ID NO: 3731 - DNA, 18 bp, Artificial Sequence
  synthetic
cagggcattagcaattat

SEQ ID NO: 3732 - protein, 6 aa, Artificial Sequence
  synthetic
QGISNY

SEQ ID NO: 3733 - DNA, 9 bp, Artificial Sequence
  synthetic
gctgcatcc

SEQ ID NO: 3734 - protein, 3 aa, Artificial Sequence
  synthetic
AAS

SEQ ID NO: 3735 - DNA, 27 bp, Artificial Sequence
  synthetic
caaaagtataacagtgcccctcggacg

SEQ ID NO: 3736 - protein, 9 aa, Artificial Sequence
  synthetic
QKYNSAPRT

SEQ ID NO: 3737 - DNA, 381 bp, Artificial Sequence
  synthetic
caggtgcagctggtggagtctgggggaggcgttatacagcggggggggtccctgagactctcctgtgcagcctctggattcacctttgatgattatgccatgcactgggtccgtcaagttccagggaagggtctggagtgggtctctcttattagttgggatggtggcagcacatactatgcagactctgtgaagggccgattcaccatctccagagacaacagcaaaaagtccctgtatctgcaaatgagcagtccgacagctgaggacaccgccgtgtattactgtgcaaaagagatatccccttctacagatccttattactactactatttcggtatggacgtctggggccaagggaccacggtcaccgtctcctca

SEQ ID NO: 3738 - protein, 127 aa, Artificial Sequence
  synthetic
QVQLVESGGGVIQRGGSLRLSCAASGFTFDDYAMHWVRQVPGKGLEWVSLISWDGGSTYYADSVKGRFTISRDNSKKSLYLQMSSPTAEDTAVYYCAKEISPSTDPYYYYYFGMDVWGQGTTVTVSS

SEQ ID NO: 3739 - DNA, 24 bp, Artificial Sequence
  synthetic
ggattcacctttgatgattatgcc

SEQ ID NO: 3740 - protein, 8 aa, Artificial Sequence
  synthetic
GFTFDDYA

SEQ ID NO: 3741 - DNA, 24 bp, Artificial Sequence
  synthetic
attagttgggatggtggcagcaca

SEQ ID NO: 3742 - protein, 8 aa, Artificial Sequence
  synthetic
ISWDGGST

SEQ ID NO: 3743 - DNA, 60 bp, Artificial Sequence; identical to SEQ ID NO: 3551
  synthetic

SEQ ID NO: 3744 - protein, 20 aa, Artificial Sequence
  synthetic
AKEISPSTDPYYYYYFGMDV

SEQ ID NO: 3745 - DNA, 324 bp, Artificial Sequence
  synthetic
gacatcgtgatgacccagtctccaggcaccctgtctttgtctccaggggaaagagccaccctctcctgcaggaccagtcagattattaatgacaactacttcgcctggtatcagcagaaacctggccaggctcccaggctcctcatctatgctacatccaccagggccactggcatcccagacaggttcagtggcagtgggtctgggacagacttcactctcaccatcagcagactggagcctgaagattttgcagtgtattactgtcagcattatggtacctcacctccttttggccaggggaccaaggtggagatcaaacga

SEQ ID NO: 3746 - protein, 108 aa, Artificial Sequence
  synthetic
DIVMTQSPGTLSLSPGERATLSCRTSQIINDNYFAWYQQKPGQAPRLLIYATSTRATGIPDRFSGSGSGTDFTLTISRLEPEDFAVYYCQHYGTSPPFGQGTKVEIKR

SEQ ID NO: 3747 - DNA, 21 bp, Artificial Sequence
  synthetic
cagattattaatgacaactac

SEQ ID NO: 3748 - protein, 7 aa, Artificial Sequence
  synthetic
QIINDNY

SEQ ID NO: 3749 - DNA, 9 bp, Artificial Sequence
  synthetic
gctacatcc

SEQ ID NO: 3750 - protein, 3 aa, Artificial Sequence
  synthetic
ATS

SEQ ID NO: 3751 - DNA, 24 bp, Artificial Sequence
  synthetic
cagcattatggtacctcacctcct

SEQ ID NO: 3752 - protein, 8 aa, Artificial Sequence
  synthetic
QHYGTSPP

SEQ ID NO: 3753 - DNA, 381 bp, Artificial Sequence
  synthetic
caggtgcagctggtggagtctgggggaggcgttataccgcggggggggtccctgagactctcctgtgcagcctctggattcacctttgatgattatgccatgcactgggtccgtcaagttccagggaagggactggagtgggtctctcttattagttgggatggtggtttcacacactatgcagactctgtgaagggccgattcaccatctccagagacaacagcaaaaagtccctgtatctgcaaatgagcagtccgacaactgaggacaccgccttgtattactgtgcaaaagagatatccccttctacagatccttattactactactatttcggtatggacgtctggggccaagggaccacggtcaccgtctcctca

SEQ ID NO: 3754 - protein, 127 aa, Artificial Sequence
  synthetic
QVQLVESGGGVIPRGGSLRLSCAASGFTFDDYAMHWVRQVPGKGLEWVSLISWDGGFTHYADSVKGRFTISRDNSKKSLYLQMSSPTTEDTALYYCAKEISPSTDPYYYYYFGMDVWGQGTTVTVSS

SEQ ID NO: 3755 - DNA, 24 bp, Artificial Sequence
  synthetic
ggattcacctttgatgattatgcc

SEQ ID NO: 3756 - protein, 8 aa, Artificial Sequence
  synthetic
GFTFDDYA

SEQ ID NO: 3757 - DNA, 24 bp, Artificial Sequence
  synthetic
attagttgggatggtggtttcaca

SEQ ID NO: 3758 - protein, 8 aa, Artificial Sequence
  synthetic
ISWDGGFT

SEQ ID NO: 3759 - DNA, 60 bp, Artificial Sequence; identical to SEQ ID NO: 3551
  synthetic

SEQ ID NO: 3760 - protein, 20 aa, Artificial Sequence
  synthetic
AKEISPSTDPYYYYYFGMDV

SEQ ID NO: 3761 - DNA, 324 bp, Artificial Sequence
  synthetic
gacatcgtgatgacccagtctccaggcaccctgtctttgtctccaggggaaagagccaccctctcctgcaggaccagtcagattcttaatggcaactacttcgcctggtatcagcagaaacctggccaggctcccaggctcctcatctatgctacatccagcagggccactggcatcccagacaggttcagtggcagtgggtctgggacagacttcactctcaccatcagcagactggagcctgaagattttgcagtgtattactgtcagcattatggcacctcacctccttttggccaggggaccaaggtggagatcaaacga

SEQ ID NO: 3762 - protein, 108 aa, Artificial Sequence
  synthetic
DIVMTQSPGTLSLSPGERATLSCRTSQILNGNYFAWYQQKPGQAPRLLIYATSSRATGIPDRFSGSGSGTDFTLTISRLEPEDFAVYYCQHYGTSPPFGQGTKVEIKR

SEQ ID NO: 3763 - DNA, 21 bp, Artificial Sequence
  synthetic
cagattcttaatggcaactac

SEQ ID NO: 3764 - protein, 7 aa, Artificial Sequence
  synthetic
QILNGNY

SEQ ID NO: 3765 - DNA, 9 bp, Artificial Sequence
  synthetic
gctacatcc

SEQ ID NO: 3766 - protein, 3 aa, Artificial Sequence
  synthetic
ATS

SEQ ID NO: 3767 - DNA, 24 bp, Artificial Sequence
  synthetic
cagcattatggcacctcacctcct

SEQ ID NO: 3768 - protein, 8 aa, Artificial Sequence
  synthetic
QHYGTSPP

SEQ ID NO: 3769 - DNA, 366 bp, Artificial Sequence
  synthetic
gaggtgcagctggtggagtctggaggtgaggtgaaaaagcccggggagtctctgaagatctcctgtaagggttctggatacaacttttccaaaaactggatcggctgggtgcgccagatgcccgggaaaggcctggagtggatggggatcatctatcctcgtgactctgatatcagatacagtccgtccttccaaggccaggtcaccatgtcagccgacaagtccatcaacaccgcctatctgcagtggagtagcctgaaggcctcggacaccgccatgtatttctgtgcgagactcggggacctatggcatcagtattatggtatggacgtctggggccaagggaccacggtcaccgtctcctca

SEQ ID NO: 3770 - protein, 122 aa, Artificial Sequence
  synthetic
EVQLVESGGEVKKPGESLKISCKGSGYNFSKNWIGWVRQMPGKGLEWMGIIYPRDSDIRYSPSFQGQVTMSADKSINTAYLQWSSLKASDTAMYFCARLGDLWHQYYGMDVWGQGTTVTVSS

SEQ ID NO: 3771 - DNA, 24 bp, Artificial Sequence
  synthetic
ggatacaacttttccaaaaactgg

SEQ ID NO: 3772 - protein, 8 aa, Artificial Sequence
  synthetic
GYNFSKNW

SEQ ID NO: 3773 - DNA, 24 bp, Artificial Sequence
  synthetic
atctatcctcgtgactctgatatc

SEQ ID NO: 3774 - protein, 8 aa, Artificial Sequence
  synthetic
IYPRDSDI

SEQ ID NO: 3775 - DNA, 45 bp, Artificial Sequence
  synthetic
gcgagactcggggacctatggcatcagtattatggtatggacgtc

SEQ ID NO: 3776 - protein, 15 aa, Artificial Sequence
  synthetic
ARLGDLWHQYYGMDV

SEQ ID NO: 3777 - DNA, 324 bp, Artificial Sequence
  synthetic
gacatcctgatgacccagtctccatcctccctgtctgcttctgtaggagacagagtcaccatcacttgccggacgagtcagaccattagtaattatttaaattggtatcaacagaaaccagggaaagcccctaaactcctgatctatgctgcatccagtttgcaaagtggggtcccatcaaggttcagtggcagtggatctgggacagatttcactctcaccatcagcattcttcaacctgaagattttgcaacttactactgtcaacagagttacagtgccccgtacacttttggccaggggaccaaggtggagatcaaacga

SEQ ID NO: 3778 - protein, 108 aa, Artificial Sequence
  synthetic
DILMTQSPSSLSASVGDRVTITCRTSQTISNYLNWYQQKPGKAPKLLIYAASSLQSGVPSRFSGSGSGTDFTLTISILQPEDFATYYCQQSYSAPYTFGQGTKVEIKR

SEQ ID NO: 3779 - DNA, 18 bp, Artificial Sequence
  synthetic
cagaccattagtaattat

SEQ ID NO: 3780 - protein, 6 aa, Artificial Sequence
  synthetic
QTISNY

SEQ ID NO: 3781 - DNA, 9 bp, Artificial Sequence
  synthetic
gctgcatcc

SEQ ID NO: 3782 - protein, 3 aa, Artificial Sequence
  synthetic
AAS

SEQ ID NO: 3783 - DNA, 27 bp, Artificial Sequence
  synthetic
caacagagttacagtgccccgtacact

SEQ ID NO: 3784 - protein, 9 aa, Artificial Sequence
  synthetic
QQSYSAPYT

SEQ ID NO: 3785 - DNA, 366 bp, Artificial Sequence
  synthetic
gaggtgcagctggtggagtctggagcagaggtgaaaaagcccggggagtctctgaagatctcctgtaagggttctggatacagctttatcaactactggatcggctgggtgcgccagaggcccgggaagggcctggagtggatggggttcatctatcctggtgactctgataccagatatagtccgtccttccaaggccaggtcaccatctcagccgacaagtccatcaatattgtctacctgcagtggagcagcctgaaggcctcggacaccgccatgtattactgtgcgagacagggaaggtatataataacagctggtcactttgaccactggggccagggaaccctggtcaccgtctcctca

SEQ ID NO: 3786 - protein, 122 aa, Artificial Sequence
  synthetic
EVQLVESGAEVKKPGESLKISCKGSGYSFINYWIGWVRQRPGKGLEWMGFIYPGDSDTRYSPSFQGQVTISADKSINIVYLQWSSLKASDTAMYYCARQGRYIITAGHFDHWGQGTLVTVSS

SEQ ID NO: 3787 - DNA, 24 bp, Artificial Sequence
  synthetic
ggatacagctttatcaactactgg

SEQ ID NO: 3788 - protein, 8 aa, Artificial Sequence
  synthetic
GYSFINYW

SEQ ID NO: 3789 - DNA, 24 bp, Artificial Sequence
  synthetic
atctatcctggtgactctgatacc

SEQ ID NO: 3790 - protein, 8 aa, Artificial Sequence
  synthetic
IYPGDSDT

SEQ ID NO: 3791 - DNA, 45 bp, Artificial Sequence
  synthetic
gcgagacagggaaggtatataataacagctggtcactttgaccac

SEQ ID NO: 3792 - protein, 15 aa, Artificial Sequence
  synthetic
ARQGRYIITAGHFDH

SEQ ID NO: 3793 - DNA, 321 bp, Artificial Sequence
  synthetic
gacatcgtgatgacccagtctccatcctccctgtctgcatctgtaggagacagagtcaccatcacttgccgggcaagtcagagcattagtagctatttaaattggtatcagcagaaaccagggaaagcccctaaagtcctgatctatgatgtatccagtttgcaaagtggggtcccatcaaggttcagtggcagtggatctgggacagatttcactctcaccatcagcagtctgcaacctgaagattttgcaacttactactgtcaacagacttacaaaaccctcactttcggcggagggaccaaggtggagatcaaacga

SEQ ID NO: 3794 - protein, 107 aa, Artificial Sequence
  synthetic
DIVMTQSPSSLSASVGDRVTITCRASQSISSYLNWYQQKPGKAPKVLIYDVSSLQSGVPSRFSGSGSGTDFTLTISSLQPEDFATYYCQQTYKTLTFGGGTKVEIKR

SEQ ID NO: 3795 - DNA, 18 bp, Artificial Sequence
  synthetic
cagagcattagtagctat

SEQ ID NO: 3796 - protein, 6 aa, Artificial Sequence
  synthetic
QSISSY

SEQ ID NO: 3797 - DNA, 9 bp, Artificial Sequence
  synthetic
gatgtatcc

SEQ ID NO: 3798 - protein, 3 aa, Artificial Sequence
  synthetic
DVS

SEQ ID NO: 3799 - DNA, 24 bp, Artificial Sequence
  synthetic
caacagacttacaaaaccctcact

SEQ ID NO: 3800 - protein, 8 aa, Artificial Sequence
  synthetic
QQTYKTLT

SEQ ID NO: 3801 - DNA, 378 bp, Artificial Sequence
  synthetic
gaggtgcagctggtggagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaaggctccgactacagtaactacttttactactactactacggtatggacgtctggggccaagggaccacggtcaccgtctcctca

SEQ ID NO: 3802 - protein, 126 aa, Artificial Sequence
  synthetic
EVQLVESGGGVVQPGGSLRLSCAASGFTFDDYAMHWVRQAPGKGLEWVSLISGDGGSTYYADSVKGRFTISRDNSKNSLYLQMNSLRTEDTALYYCAKGSDYSNYFYYYYYGMDVWGQGTTVTVSS

SEQ ID NO: 3803 - DNA, 24 bp, Artificial Sequence
  synthetic
ggattcacctttgatgattatgcc

SEQ ID NO: 3804 - protein, 8 aa, Artificial Sequence
  synthetic
GFTFDDYA

SEQ ID NO: 3805 - DNA, 24 bp, Artificial Sequence
  synthetic
attagtggggatggtggtagcaca

SEQ ID NO: 3806 - protein, 8 aa, Artificial Sequence
  synthetic
ISGDGGST

SEQ ID NO: 3807 - DNA, 57 bp, Artificial Sequence
  synthetic
gcaaaaggctccgactacagtaactacttttactactactactacggtatggacgtc

SEQ ID NO: 3808 - protein, 19 aa, Artificial Sequence
  synthetic
AKGSDYSNYFYYYYYGMDV

SEQ ID NO: 3809 - DNA, 324 bp, Artificial Sequence
  synthetic
gacatcgtgatgacccagtctccaggcaccctgtctttgtctccaggggatagagccaccctctcctgcagggccagtcagagtgtaagcagcagttacttagcctggtaccagcagaaacctggccaggctcccaggctcctcatctatgctacatccaacagggccactggcatcccagacaggttcagtggcagtgggtctgggacagacttcactctcaccatcagcagactggagcctgaagattttgcagtgtattactgtcagcagtatgttggctcacctccttttggccaggggaccaaggtggagatcaaacga

SEQ ID NO: 3810 - protein, 108 aa, Artificial Sequence
  synthetic
DIVMTQSPGTLSLSPGDRATLSCRASQSVSSSYLAWYQQKPGQAPRLLIYATSNRATGIPDRFSGSGSGTDFTLTISRLEPEDFAVYYCQQYVGSPPFGQGTKVEIKR

SEQ ID NO: 3811 - DNA, 21 bp, Artificial Sequence
  synthetic
cagagtgtaagcagcagttac

SEQ ID NO: 3812 - protein, 7 aa, Artificial Sequence
  synthetic
QSVSSSY

SEQ ID NO: 3813 - DNA, 9 bp, Artificial Sequence
  synthetic
gctacatcc

SEQ ID NO: 3814 - protein, 3 aa, Artificial Sequence
  synthetic
ATS

SEQ ID NO: 3815 - DNA, 24 bp, Artificial Sequence
  synthetic
cagcagtatgttggctcacctcct

SEQ ID NO: 3816 - protein, 8 aa, Artificial Sequence
  synthetic
QQYVGSPP

SEQ ID NO: 3817 - DNA, 381 bp, Artificial Sequence
  synthetic
gaggtgcagctggtggagtcggggggaggcgtagtacagcctggggggtccctgagactctcctgtgcagcctctggattcacctttgatgattatgccatgcactgggtccgtcaagttccagggaagggtctggagtgggtctctctcattaattgggatggacgtagtacatattatgcagactctgtgaagggccgattcaccatctccagagacaacagcaaaaactccctgtggctgcaaatgaacagtctgagaactgaagacagcgccttgtattactgtgcaaaagagatttccccttctacagatccttattacttctactacttcggtatggacgtctggggccaagggaccacggtcaccgtctcctca

SEQ ID NO: 3818 - protein, 127 aa, Artificial Sequence
  synthetic
EVQLVESGGGVVQPGGSLRLSCAASGFTFDDYAMHWVRQVPGKGLEWVSLINWDGRSTYYADSVKGRFTISRDNSKNSLWLQMNSLRTEDSALYYCAKEISPSTDPYYFYYFGMDVWGQGTTVTVSS

SEQ ID NO: 3819 - DNA, 24 bp, Artificial Sequence
  synthetic
ggattcacctttgatgattatgcc

SEQ ID NO: 3820 - protein, 8 aa, Artificial Sequence
  synthetic
GFTFDDYA

SEQ ID NO: 3821 - DNA, 24 bp, Artificial Sequence
  synthetic
attaattgggatggacgtagtaca

SEQ ID NO: 3822 - protein, 8 aa, Artificial Sequence
  synthetic
INWDGRST

SEQ ID NO: 3823 - DNA, 60 bp, Artificial Sequence; identical to SEQ ID NO: 3583
  synthetic

SEQ ID NO: 3824 - protein, 20 aa, Artificial Sequence
  synthetic
AKEISPSTDPYYFYYFGMDV

SEQ ID NO: 3825 - DNA, 324 bp, Artificial Sequence
  synthetic
gacatcgtgatgacccagtctccaggcaccctatctttgtctccaggggaaagagccaccctctcctgcagggccagtcagagtgttagcagcagcttcttagcctggtaccagcagaaacctggccaggctcccaggctcctcatctatgctacatccagcagggccactggcatcccagacaggttcagtggcagtgggtctgggacagacttcactctcaccatcagcagactggagcctgaagattttgcagtctattactgtcagcagtatgttggctcacctccttttggccaggggaccaaggtggagatcaaacga

SEQ ID NO: 3826 - protein, 108 aa, Artificial Sequence
  synthetic
DIVMTQSPGTLSLSPGERATLSCRASQSVSSSFLAWYQQKPGQAPRLLIYATSSRATGIPDRFSGSGSGTDFTLTISRLEPEDFAVYYCQQYVGSPPFGQGTKVEIKR

SEQ ID NO: 3827 - DNA, 21 bp, Artificial Sequence
  synthetic
cagagtgttagcagcagcttc

SEQ ID NO: 3828 - protein, 7 aa, Artificial Sequence
  synthetic
QSVSSSF

SEQ ID NO: 3829 - DNA, 9 bp, Artificial Sequence
  synthetic
gctacatcc

SEQ ID NO: 3830 - protein, 3 aa, Artificial Sequence
  synthetic
ATS

SEQ ID NO: 3831 - DNA, 24 bp, Artificial Sequence
  synthetic
cagcagtatgttggctcacctcct

SEQ ID NO: 3832 - protein, 8 aa, Artificial Sequence
  synthetic
QQYVGSPP

SEQ ID NO: 3833 - DNA, 381 bp, Artificial Sequence; identical to SEQ ID NO: 3641
  synthetic

SEQ ID NO: 3834 - protein, 127 aa, Artificial Sequence; identical to SEQ ID NO: 3642
  synthetic

SEQ ID NO: 3835 - DNA, 24 bp, Artificial Sequence
  synthetic
ggattcacctttgatgattatgcc

SEQ ID NO: 3836 - protein, 8 aa, Artificial Sequence
  synthetic
GFTFDDYA

SEQ ID NO: 3837 - DNA, 24 bp, Artificial Sequence
  synthetic
attagttgggatggtggtagcaca

SEQ ID NO: 3838 - protein, 8 aa, Artificial Sequence
  synthetic
ISWDGGST

SEQ ID NO: 3839 - DNA, 60 bp, Artificial Sequence; identical to SEQ ID NO: 3551
  synthetic

SEQ ID NO: 3840 - protein, 20 aa, Artificial Sequence
  synthetic
AKEISPSTDPYYYYYFGMDV

SEQ ID NO: 3841 - DNA, 324 bp, Artificial Sequence; identical to SEQ ID NO: 3713
  synthetic

SEQ ID NO: 3842 - protein, 108 aa, Artificial Sequence; identical to SEQ ID NO: 3554
  synthetic

SEQ ID NO: 3843 - DNA, 21 bp, Artificial Sequence
  synthetic
cagattattaatgacaactac

SEQ ID NO: 3844 - protein, 7 aa, Artificial Sequence
  synthetic
QIINDNY

SEQ ID NO: 3845 - DNA, 9 bp, Artificial Sequence
  synthetic
gctacatcc

SEQ ID NO: 3846 - protein, 3 aa, Artificial Sequence
  synthetic
ATS

SEQ ID NO: 3847 - DNA, 24 bp, Artificial Sequence
  synthetic
cagcattatggtacctcacctcct

SEQ ID NO: 3848 - protein, 8 aa, Artificial Sequence
  synthetic
QHYGTSPP

SEQ ID NO: 3849 - DNA, 372 bp, Artificial Sequence
  synthetic
caggtgcagctggtggagtcgggcccaggactggtgaagccttcggagaccctgtccctcacctgcactgtctctggtggctccatcagtagttactactggagctggatccggcagcccccagggaagggactggagtggattggttatatctataatagtgggagcaccaactacaacccctccctcaggagtcgactcaccatttcagtagacacgtccaagaaccagttctccctgaagctgagctctgtgaccgccacagacacggccgtgtatcactgtgcgagaagtcattacgatattttgactggttattataatgggtactttgactactggggccagggaaccacggtcaccgtctcctca

SEQ ID NO: 3850 - protein, 124 aa, Artificial Sequence
  synthetic
QVQLVESGPGLVKPSETLSLTCTVSGGSISSYYWSWIRQPPGKGLEWIGYIYNSGSTNYNPSLRSRLTISVDTSKNQFSLKLSSVTATDTAVYHCARSHYDILTGYYNGYFDYWGQGTTVTVSS

SEQ ID NO: 3851 - DNA, 24 bp, Artificial Sequence
  synthetic
ggtggctccatcagtagttactac

SEQ ID NO: 3852 - protein, 8 aa, Artificial Sequence
  synthetic
GGSISSYY

SEQ ID NO: 3853 - DNA, 21 bp, Artificial Sequence
  synthetic
atctataatagtgggagcacc

SEQ ID NO: 3854 - protein, 7 aa, Artificial Sequence
  synthetic
IYNSGST

SEQ ID NO: 3855 - DNA, 54 bp, Artificial Sequence
  synthetic
gcgagaagtcattacgatattttgactggttattataatgggtactttgactac

SEQ ID NO: 3856 - protein, 18 aa, Artificial Sequence
  synthetic
ARSHYDILTGYYNGYFDY

SEQ ID NO: 3857 - DNA, 342 bp, Artificial Sequence
  synthetic
gacatcctgatgacccagtctccagactccctggctgtgtctctgggcgagagggccaccatcaactgcaagtccagccagaatattttgttcagttccaacaataagaactacttagcttggtaccagcagaaaccaggacagcctcctaaactactcatttactgggcatctacccgggaatccggggtccctgaccgattcagtggcagcgggtctgggacagatttcactctcaccatcagcagcctgcaggctgaagatgtggcaatttattactgtcagcaatattataatactccgtggacgttcggccaagggaccaaggtggagatcaaacga

SEQ ID NO: 3858 - protein, 114 aa, Artificial Sequence
  synthetic
DILMTQSPDSLAVSLGERATINCKSSQNILFSSNNKNYLAWYQQKPGQPPKLLIYWASTRESGVPDRFSGSGSGTDFTLTISSLQAEDVAIYYCQQYYNTPWTFGQGTKVEIKR

SEQ ID NO: 3859 - DNA, 36 bp, Artificial Sequence
  synthetic
cagaatattttgttcagttccaacaataagaactac

SEQ ID NO: 3860 - protein, 12 aa, Artificial Sequence
  synthetic
QNILFSSNNKNY

SEQ ID NO: 3861 - DNA, 9 bp, Artificial Sequence
  synthetic
tgggcatct

SEQ ID NO: 3862 - protein, 3 aa, Artificial Sequence
  synthetic
WAS

SEQ ID NO: 3863 - DNA, 27 bp, Artificial Sequence
  synthetic
cagcaatattataatactccgtggacg

SEQ ID NO: 3864 - protein, 9 aa, Artificial Sequence
  synthetic
QQYYNTPWT

SEQ ID NO: 3865 - DNA, 372 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagtatagactatgcggactctgtgaagggccgattcaccgtctccagagacaacgccaagaactccctgtatctgcacatgaacagtctgagagttgaggacacggccttgtattactgtgcaaaagatatgaccttacgatttttggagtggttaaacggtatggacgtctggggccaagggaccacggtcaccgtctcctca

SEQ ID NO: 3866 - protein, 124 aa, Artificial Sequence
  synthetic
EVQLVESGGGLVQPGRSLRLSCAASGFTFDDYAMHWVRQAPGKGLEWVSGISWNSGSIDYADSVKGRFTVSRDNAKNSLYLHMNSLRVEDTALYYCAKDMTLRFLEWLNGMDVWGQGTTVTVSS

SEQ ID NO: 3867 - DNA, 24 bp, Artificial Sequence
  synthetic
ggattcacctttgatgattatgcc

SEQ ID NO: 3868 - protein, 8 aa, Artificial Sequence
  synthetic
GFTFDDYA

SEQ ID NO: 3869 - DNA, 24 bp, Artificial Sequence
  synthetic
attagttggaatagtggtagtata

SEQ ID NO: 3870 - protein, 8 aa, Artificial Sequence
  synthetic
ISWNSGSI

SEQ ID NO: 3871 - DNA, 51 bp, Artificial Sequence
  synthetic
gcaaaagatatgaccttacgatttttggagtggttaaacggtatggacgtc

SEQ ID NO: 3872 - protein, 17 aa, Artificial Sequence
  synthetic
AKDMTLRFLEWLNGMDV

SEQ ID NO: 3873 - DNA, 327 bp, Artificial Sequence
  synthetic
gacatcgtgatgacccagtctccaggcaccctgtctttgtctccaggggaaagagccaccctctcctgcagggccagtcagggtgttacaagcacctacttagcctggtaccagcagaaacctggccaggttcccaggctcctcatctatggtgcatccaacagggccactggcatcccagacaggttcagtggcagtgggtctgggacagacttcactctcaccatcagcagactggagcctgaagattttgcggtgtattactgtcagcaatataataactcaccgctcactttcggcggagggaccaaggtggagatcaaacga

SEQ ID NO: 3874 - protein, 109 aa, Artificial Sequence
  synthetic
DIVMTQSPGTLSLSPGERATLSCRASQGVTSTYLAWYQQKPGQVPRLLIYGASNRATGIPDRFSGSGSGTDFTLTISRLEPEDFAVYYCQQYNNSPLTFGGGTKVEIKR

SEQ ID NO: 3875 - DNA, 21 bp, Artificial Sequence
  synthetic
cagggtgttacaagcacctac

SEQ ID NO: 3876 - protein, 7 aa, Artificial Sequence
  synthetic
QGVTSTY

SEQ ID NO: 3877 - DNA, 9 bp, Artificial Sequence
  synthetic
ggtgcatcc

SEQ ID NO: 3878 - protein, 3 aa, Artificial Sequence
  synthetic
GAS

SEQ ID NO: 3879 - DNA, 27 bp, Artificial Sequence
  synthetic
cagcaatataataactcaccgctcact

SEQ ID NO: 3880 - protein, 9 aa, Artificial Sequence
  synthetic
QQYNNSPLT

SEQ ID NO: 3881 - DNA, 360 bp, Artificial Sequence
  synthetic
gaggtgcagctggtggagtctgggggagggttggtacagcctggggggtccctgagactctcctgtgcagcctctggattcacctttagcagctatgccatgacctgggtccgccaggatccagggaaggggctggagtgggtctcagctattagtggtagtggtcataacacatactatgcagactccgtgaagggccggttcaccatctccagagacaattccaagaacacactgtatctccaaatgaacagcctgagagccgaggacacggccgtatattactgtgcgaaattgggcatagtgggagatactccctttgactactggggccagggaaccctggtcaccgtctcctca

SEQ ID NO: 3882 - protein, 120 aa, Artificial Sequence
  synthetic
EVQLVESGGGLVQPGGSLRLSCAASGFTFSSYAMTWVRQDPGKGLEWVSAISGSGHNTYYADSVKGRFTISRDNSKNTLYLQMNSLRAEDTAVYYCAKLGIVGDTPFDYWGQGTLVTVSS

SEQ ID NO: 3883 - DNA, 24 bp, Artificial Sequence
  synthetic
ggattcacctttagcagctatgcc

SEQ ID NO: 3884 - protein, 8 aa, Artificial Sequence
  synthetic
GFTFSSYA

SEQ ID NO: 3885 - DNA, 24 bp, Artificial Sequence
  synthetic
attagtggtagtggtcataacaca

SEQ ID NO: 3886 - protein, 8 aa, Artificial Sequence
  synthetic
ISGSGHNT

SEQ ID NO: 3887 - DNA, 39 bp, Artificial Sequence
  synthetic
gcgaaattgggcatagtgggagatactccctttgactac

SEQ ID NO: 3888 - protein, 13 aa, Artificial Sequence
  synthetic
AKLGIVGDTPFDY

SEQ ID NO: 3889 - DNA, 324 bp, Artificial Sequence
  synthetic
gacatcctgatgacccagtctccatcctccctgtctgcatctgtaggagacagagtcaccatcacttgccgggcaagtcagagcatgagcagctatttacattggtatcagcagaaaccagggaaagcccctaagctcctgatctatgctgcatcccgtttgcaaagtggggtcccatccaggttcagtggcagtggatctgggacagatttcactctcaccatcagcagtctgcaacctgaagattttgcaacttactactgtcaacagagtttcagtacccctccgacgttcggccaagggaccaaggtggagatcaaacga

SEQ ID NO: 3890 - protein, 108 aa, Artificial Sequence
  synthetic
DILMTQSPSSLSASVGDRVTITCRASQSMSSYLHWYQQKPGKAPKLLIYAASRLQSGVPSRFSGSGSGTDFTLTISSLQPEDFATYYCQQSFSTPPTFGQGTKVEIKR

SEQ ID NO: 3891 - DNA, 18 bp, Artificial Sequence
  synthetic
cagagcatgagcagctat

SEQ ID NO: 3892 - protein, 6 aa, Artificial Sequence
  synthetic
QSMSSY

SEQ ID NO: 3893 - DNA, 9 bp, Artificial Sequence
  synthetic
gctgcatcc

SEQ ID NO: 3894 - protein, 3 aa, Artificial Sequence
  synthetic
AAS

SEQ ID NO: 3895 - DNA, 27 bp, Artificial Sequence
  synthetic
caacagagtttcagtacccctccgacg

SEQ ID NO: 3896 - protein, 9 aa, Artificial Sequence
  synthetic
QQSFSTPPT

SEQ ID NO: 3897 - DNA, 363 bp, Artificial Sequence
  synthetic
gaggtgcagctggtggagtctgggggaggcttggtacagcctggagggtccctgagactctcctgtgcatcctctggattcaccctcagtagttatgaagtgaactgggtccgccaggctccagggaaggggctggagtgggtttcatatattagcagaagtagtagcaccatatattacgccgactctgtgaagggccgattcaccatctccagagacaacgccaagaatttattgtttctgcaaatgaacagcctgagagccgaggacacggctgtttattactgtgcgagagatcgaggctacgtctccgggggtggtatggacgtctggggccaagggaccacggtcaccgtctcctca

SEQ ID NO: 3898 - protein, 121 aa, Artificial Sequence
  synthetic
EVQLVESGGGLVQPGGSLRLSCASSGFTLSSYEVNWVRQAPGKGLEWVSYISRSSSTIYYADSVKGRFTISRDNAKNLLFLQMNSLRAEDTAVYYCARDRGYVSGGGMDVWGQGTTVTVSS

SEQ ID NO: 3899 - DNA, 24 bp, Artificial Sequence
  synthetic
ggattcaccctcagtagttatgaa

SEQ ID NO: 3900 - protein, 8 aa, Artificial Sequence
  synthetic
GFTLSSYE

SEQ ID NO: 3901 - DNA, 24 bp, Artificial Sequence
  synthetic
attagcagaagtagtagcaccata

SEQ ID NO: 3902 - protein, 8 aa, Artificial Sequence
  synthetic
ISRSSSTI

SEQ ID NO: 3903 - DNA, 42 bp, Artificial Sequence
  synthetic
gcgagagatcgaggctacgtctccgggggtggtatggacgtc

SEQ ID NO: 3904 - protein, 14 aa, Artificial Sequence
  synthetic
ARDRGYVSGGGMDV

SEQ ID NO: 3905 - DNA, 324 bp, Artificial Sequence
  synthetic
gacatccagatgacccagtctccatcctccctgtctgcatctgtaggagacagagtcaccatcacttgccgggcaagtcagagcattagcacctatttaaattggtatcagcagaaatcagggaaagcccctaagatcctgatctttgctgcatccagtttgcaaagtcgggtcccatcaaggttcagtggcagtggatctgggacagatttcactctcaccatcaccagtctgcaacctgaagattttgcaacttactactgtcaacagacttacagtcccccattcactttcggccctgggaccaaggtggagatcaaacga

SEQ ID NO: 3906 - protein, 108 aa, Artificial Sequence
  synthetic
DIQMTQSPSSLSASVGDRVTITCRASQSISTYLNWYQQKSGKAPKILIFAASSLQSRVPSRFSGSGSGTDFTLTITSLQPEDFATYYCQQTYSPPFTFGPGTKVEIKR

SEQ ID NO: 3907 - DNA, 18 bp, Artificial Sequence
  synthetic
cagagcattagcacctat

SEQ ID NO: 3908 - protein, 6 aa, Artificial Sequence
  synthetic
QSISTY

SEQ ID NO: 3909 - DNA, 9 bp, Artificial Sequence
  synthetic
gctgcatcc

SEQ ID NO: 3910 - protein, 3 aa, Artificial Sequence
  synthetic
AAS

SEQ ID NO: 3911 - DNA, 27 bp, Artificial Sequence
  synthetic
caacagacttacagtcccccattcact

SEQ ID NO: 3912 - protein, 9 aa, Artificial Sequence
  synthetic
QQTYSPPFT

SEQ ID NO: 3913 - DNA, 351 bp, Artificial Sequence
  synthetic
gaggtgcagctggtggagtctggagttgaggtgaagaagcctggggcctcagtgaaggtctcctgcaaggcttctggttacacctttaccacctatggtatcagctgggtgcgacaggcccctggacaagggcttgagtggatgggatggatcagcacttacaatggtaacagaaattatgcacagaagttccagggcagagtcaccatgaccactgacacatccacgagtacagcctacatggagctgaggagcctgtcatctgacgacacggccatgtattactgtgcgagaggaaggctggatgcttttgatatctggggccaagggacaatggtcaccgtctcttca

SEQ ID NO: 3914 - protein, 117 aa, Artificial Sequence
  synthetic
EVQLVESGVEVKKPGASVKVSCKASGYTFTTYGISWVRQAPGQGLEWMGWISTYNGNRNYAQKFQGRVTMTTDTSTSTAYMELRSLSSDDTAMYYCARGRLDAFDIWGQGTMVTVSS

SEQ ID NO: 3915 - DNA, 24 bp, Artificial Sequence
  synthetic
ggttacacctttaccacctatggt

SEQ ID NO: 3916 - protein, 8 aa, Artificial Sequence
  synthetic
GYTFTTYG

SEQ ID NO: 3917 - DNA, 24 bp, Artificial Sequence
  synthetic
atcagcacttacaatggtaacaga

SEQ ID NO: 3918 - protein, 8 aa, Artificial Sequence
  synthetic
ISTYNGNR

SEQ ID NO: 3919 - DNA, 30 bp, Artificial Sequence
  synthetic
gcgagaggaaggctggatgcttttgatatc

SEQ ID NO: 3920 - protein, 10 aa, Artificial Sequence
  synthetic
ARGRLDAFDI

SEQ ID NO: 3921 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtggggtcccatcaaggttcagtggcagtgtatctgggacagatttcactctcaccatcagcagtctgcaacctgaagattttgcaacttactattgtcaacagagttacattacccatcctactttcggcggagggaccaaggtggagatcaaacga

SEQ ID NO: 3922 - protein, 108 aa, Artificial Sequence
  synthetic
DIQMTQSPSSLSASVGDRVTITCRASQSISSYLNWYQQKPGKAPKLLIYAASSLQSGVPSRFSGSVSGTDFTLTISSLQPEDFATYYCQQSYITHPTFGGGTKVEIKR

SEQ ID NO: 3923 - DNA, 18 bp, Artificial Sequence
  synthetic
cagagcattagcagctat

SEQ ID NO: 3924 - protein, 6 aa, Artificial Sequence
  synthetic
QSISSY

SEQ ID NO: 3925 - DNA, 9 bp, Artificial Sequence
  synthetic
gctgcatcc

SEQ ID NO: 3926 - protein, 3 aa, Artificial Sequence
  synthetic
AAS

SEQ ID NO: 3927 - DNA, 27 bp, Artificial Sequence
  synthetic
caacagagttacattacccatcctact

SEQ ID NO: 3928 - protein, 9 aa, Artificial Sequence
  synthetic
QQSYITHPT

SEQ ID NO: 3929 - DNA, 363 bp, Artificial Sequence
  synthetic
gaggtgcagctggtggagtctgggggaggcttggtacagcctggagggtccctgagactctcctgtgcatcctctacattcaccctcagtagttatgaagtgaactgggtccgccaggctccagggaaggggctggagtgggtctcatatattagtagaagcagtaataccatatattacgccgactctgtgaagggccgattcaccatctccagagacaacgccaagaatttactgtttctgcaaatgaacagcctgagagccgacgacacggctgtttattattgtgcgagagatcgaggctatgtctccgggggtggtatggacgtctggggccaagggaccacggtcaccgtctcctca

SEQ ID NO: 3930 - protein, 121 aa, Artificial Sequence
  synthetic
EVQLVESGGGLVQPGGSLRLSCASSTFTLSSYEVNWVRQAPGKGLEWVSYISRSSNTIYYADSVKGRFTISRDNAKNLLFLQMNSLRADDTAVYYCARDRGYVSGGGMDVWGQGTTVTVSS

SEQ ID NO: 3931 - DNA, 24 bp, Artificial Sequence
  synthetic
acattcaccctcagtagttatgaa

SEQ ID NO: 3932 - protein, 8 aa, Artificial Sequence
  synthetic
TFTLSSYE

SEQ ID NO: 3933 - DNA, 24 bp, Artificial Sequence
  synthetic
attagtagaagcagtaataccata

SEQ ID NO: 3934 - protein, 8 aa, Artificial Sequence
  synthetic
ISRSSNTI

SEQ ID NO: 3935 - DNA, 42 bp, Artificial Sequence
  synthetic
gcgagagatcgaggctatgtctccgggggtggtatggacgtc

SEQ ID NO: 3936 - protein, 14 aa, Artificial Sequence
  synthetic
ARDRGYVSGGGMDV

SEQ ID NO: 3937 - DNA, 324 bp, Artificial Sequence
  synthetic
gacatccagatgacccagtctccatcctccctgtctgcatttgtaggagacagagtcaccatcacttgccgggcaagtcagagtataagtagttatttaaattggtatcagcagaaaccagggaaagcccctaagctcctgatctttgctgcatccagtttgcaaagtggggtcccatcaaggttcagtggcagtggatctgggacagatttcactctcaccatcaccagtctgcaacctgaagattttgcaatttactactgtcaacagacttacagtcccccattcactttcggccctgggaccaaggtggagatcaaacga

SEQ ID NO: 3938 - protein, 108 aa, Artificial Sequence
  synthetic
DIQMTQSPSSLSAFVGDRVTITCRASQSISSYLNWYQQKPGKAPKLLIFAASSLQSGVPSRFSGSGSGTDFTLTITSLQPEDFAIYYCQQTYSPPFTFGPGTKVEIKR

SEQ ID NO: 3939 - DNA, 18 bp, Artificial Sequence
  synthetic
cagagtataagtagttat

SEQ ID NO: 3940 - protein, 6 aa, Artificial Sequence
  synthetic
QSISSY

SEQ ID NO: 3941 - DNA, 9 bp, Artificial Sequence
  synthetic
gctgcatcc

SEQ ID NO: 3942 - protein, 3 aa, Artificial Sequence
  synthetic
AAS

SEQ ID NO: 3943 - DNA, 27 bp, Artificial Sequence
  synthetic
caacagacttacagtcccccattcact

SEQ ID NO: 3944 - protein, 9 aa, Artificial Sequence
  synthetic
QQTYSPPFT

SEQ ID NO: 3945 - DNA, 357 bp, Artificial Sequence
  synthetic
gaggtgcagctggtggagtcgggcccaggactggtgaagccttcggagaccctgtccctcacctgcactgtctctggtgcctccatcagtaattactactggacctggatccgtcagccccccgggaagggactagagtggattggatatatccattatagtgggagaattaactataatccctccctcaagagtcgagtcaccatctcaatagacacgtccaaaaaccagttctccctgaaactcagctctgtgaccgccgcagacacggccgtgtattactgtgcgagagagaggagggcactaactggggaccttgactactggggccagggaagcctggtcaccgtctcctca

SEQ ID NO: 3946 - protein, 119 aa, Artificial Sequence
  synthetic
EVQLVESGPGLVKPSETLSLTCTVSGASISNYYWTWIRQPPGKGLEWIGYIHYSGRINYNPSLKSRVTISIDTSKNQFSLKLSSVTAADTAVYYCARERRALTGDLDYWGQGSLVTVSS

SEQ ID NO: 3947 - DNA, 24 bp, Artificial Sequence
  synthetic
ggtgcctccatcagtaattactac

SEQ ID NO: 3948 - protein, 8 aa, Artificial Sequence
  synthetic
GASISNYY

SEQ ID NO: 3949 - DNA, 21 bp, Artificial Sequence
  synthetic
atccattatagtgggagaatt

SEQ ID NO: 3950 - protein, 7 aa, Artificial Sequence
  synthetic
IHYSGRI

SEQ ID NO: 3951 - DNA, 39 bp, Artificial Sequence
  synthetic
gcgagagagaggagggcactaactggggaccttgactac

SEQ ID NO: 3952 - protein, 13 aa, Artificial Sequence
  synthetic
ARERRALTGDLDY

SEQ ID NO: 3953 - DNA, 324 bp, Artificial Sequence
  synthetic
gacatccagatgacccagtctccatcctccctgtctgtttctgtaggagacagagtcaccatcacttgccgggcaagtcagagcattagaacctatttaaattggtatcagcagaaaccagggaaagcccctaagctcctgatctttgctgcatccagtttgcaaagtggggtcccatcaaggttcagtggcggtggatctgggacagatttcactctcaccattggcagtctgcaacatgaagattttgcgacttattactgtcaacagagttacaatcccccgctcactttcggcggagggaccaaggtggagatcaaacga

SEQ ID NO: 3954 - protein, 108 aa, Artificial Sequence
  synthetic
DIQMTQSPSSLSVSVGDRVTITCRASQSIRTYLNWYQQKPGKAPKLLIFAASSLQSGVPSRFSGGGSGTDFTLTIGSLQHEDFATYYCQQSYNPPLTFGGGTKVEIKR

SEQ ID NO: 3955 - DNA, 18 bp, Artificial Sequence
  synthetic
cagagcattagaacctat

SEQ ID NO: 3956 - protein, 6 aa, Artificial Sequence
  synthetic
QSIRTY

SEQ ID NO: 3957 - DNA, 9 bp, Artificial Sequence
  synthetic
gctgcatcc

SEQ ID NO: 3958 - protein, 3 aa, Artificial Sequence
  synthetic
AAS

SEQ ID NO: 3959 - DNA, 27 bp, Artificial Sequence
  synthetic
caacagagttacaatcccccgctcact

SEQ ID NO: 3960 - protein, 9 aa, Artificial Sequence
  synthetic
QQSYNPPLT

SEQ ID NO: 3961 - DNA, 354 bp, Artificial Sequence
  synthetic
gaggtgcagctggtggagtctgggggaggcttggtacagcctggggggtccctgagactctcctgtgcagcctctggattcacctttagcacctttgccatgagctgggtccgccaggctccagggaaggggctggagtgggtctcagctattagttctagtggtgttagcacatactacgcagactccgtgaagggccggttcaccatctccagagacaattccaagaacacgctgtatctgcaaatgaacagcctgagagccgaggacacggccgtatattactgtgcgaaaggcagcagctggtactactttgactactggggccagggaaccctggtcaccgtctcctca

SEQ ID NO: 3962 - protein, 118 aa, Artificial Sequence
  synthetic
EVQLVESGGGLVQPGGSLRLSCAASGFTFSTFAMSWVRQAPGKGLEWVSAISSSGVSTYYADSVKGRFTISRDNSKNTLYLQMNSLRAEDTAVYYCAKGSSWYYFDYWGQGTLVTVSS

SEQ ID NO: 3963 - DNA, 24 bp, Artificial Sequence
  synthetic
ggattcacctttagcacctttgcc

SEQ ID NO: 3964 - protein, 8 aa, Artificial Sequence
  synthetic
GFTFSTFA

SEQ ID NO: 3965 - DNA, 24 bp, Artificial Sequence
  synthetic
attagttctagtggtgttagcaca

SEQ ID NO: 3966 - protein, 8 aa, Artificial Sequence
  synthetic
ISSSGVST

SEQ ID NO: 3967 - DNA, 33 bp, Artificial Sequence
  synthetic
gcgaaaggcagcagctggtactactttgactac

SEQ ID NO: 3968 - protein, 11 aa, Artificial Sequence
  synthetic
AKGSSWYYFDY

SEQ ID NO: 3969 - DNA, 327 bp, Artificial Sequence
  synthetic
gacatcgtgatgacccagtctccaggcaccctgtctttgtctccaggggaaagagccaccctctcctgcagggccagtcagagtgttagcagtagttacttagcctggtaccagcagaaacctggccaggctcccaggctcctcatctatggtgcatccagcagggccactggcatcccggacaggttcagtggcagtgggtctgggacagacttcactctcaccatcagcagactggagcctgaagattttgcagtgtattactgtcagcagtatggtggctcacctcccacttttggccaggggaccaaggtggagatcaaacga

SEQ ID NO: 3970 - protein, 109 aa, Artificial Sequence
  synthetic
DIVMTQSPGTLSLSPGERATLSCRASQSVSSSYLAWYQQKPGQAPRLLIYGASSRATGIPDRFSGSGSGTDFTLTISRLEPEDFAVYYCQQYGGSPPTFGQGTKVEIKR

SEQ ID NO: 3971 - DNA, 21 bp, Artificial Sequence
  synthetic
cagagtgttagcagtagttac

SEQ ID NO: 3972 - protein, 7 aa, Artificial Sequence
  synthetic
QSVSSSY

SEQ ID NO: 3973 - DNA, 9 bp, Artificial Sequence
  synthetic
ggtgcatcc

SEQ ID NO: 3974 - protein, 3 aa, Artificial Sequence
  synthetic
GAS

SEQ ID NO: 3975 - DNA, 27 bp, Artificial Sequence
  synthetic
cagcagtatggtggctcacctcccact

SEQ ID NO: 3976 - protein, 9 aa, Artificial Sequence
  synthetic
QQYGGSPPT

SEQ ID NO: 3977 - DNA, 363 bp, Artificial Sequence
  synthetic
gaggtgcagctggtggagtctgggggaggcttggtacagcctggagggtccctgagactctcctgtgcatcctctggattcaccctcagtagttatgaagtgaactgggtccgccaggctccagggaaggggctggagtgggtttcatacattagtagaagtagtagcaccatatattacggcgactctgtgaagggccgattcaccatttccagagacaacgccaagaactcactgtttctgcaaatgaacagcctgagagccgaggacacggctgtttattactgtgcgagagatcgaggctacgtctccgggggtggtatggacgtctggggccaagggaccacggtcaccgtctcctca

SEQ ID NO: 3978 - protein, 121 aa, Artificial Sequence
  synthetic
EVQLVESGGGLVQPGGSLRLSCASSGFTLSSYEVNWVRQAPGKGLEWVSYISRSSSTIYYGDSVKGRFTISRDNAKNSLFLQMNSLRAEDTAVYYCARDRGYVSGGGMDVWGQGTTVTVSS

SEQ ID NO: 3979 - DNA, 24 bp, Artificial Sequence
  synthetic
ggattcaccctcagtagttatgaa

SEQ ID NO: 3980 - protein, 8 aa, Artificial Sequence
  synthetic
GFTLSSYE

SEQ ID NO: 3981 - DNA, 24 bp, Artificial Sequence
  synthetic
attagtagaagtagtagcaccata

SEQ ID NO: 3982 - protein, 8 aa, Artificial Sequence
  synthetic
ISRSSSTI

SEQ ID NO: 3983 - DNA, 42 bp, Artificial Sequence; identical to SEQ ID NO: 3903
  synthetic

SEQ ID NO: 3984 - protein, 14 aa, Artificial Sequence
  synthetic
ARDRGYVSGGGMDV

SEQ ID NO: 3985 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagatcctgatctttgctgcatccagtttgcaaagtggggtcccatcaaggttcagtggcagtggatctgggacagatttcactctcaccatcaccagtctgcaacctgaagattttgcaacttactactgtcaacagacttacagtcccccattcactttcggccctgggaccaaggtggagatcaaacga

SEQ ID NO: 3986 - protein, 108 aa, Artificial Sequence
  synthetic
DIQMTQSPSSLSASVGDRVTITCRASQSISSYLNWYQQKPGKAPKILIFAASSLQSGVPSRFSGSGSGTDFTLTITSLQPEDFATYYCQQTYSPPFTFGPGTKVEIKR

SEQ ID NO: 3987 - DNA, 18 bp, Artificial Sequence
  synthetic
cagagcattagcagctat

SEQ ID NO: 3988 - protein, 6 aa, Artificial Sequence
  synthetic
QSISSY

SEQ ID NO: 3989 - DNA, 9 bp, Artificial Sequence
  synthetic
gctgcatcc

SEQ ID NO: 3990 - protein, 3 aa, Artificial Sequence
  synthetic
AAS

SEQ ID NO: 3991 - DNA, 27 bp, Artificial Sequence
  synthetic
caacagacttacagtcccccattcact

SEQ ID NO: 3992 - protein, 9 aa, Artificial Sequence
  synthetic
QQTYSPPFT

SEQ ID NO: 3993 - DNA, 357 bp, Artificial Sequence
  synthetic
gaggtgcagctggtggagtcgggcccaggactggtgaagccttcggagaccctgtccctcacctgcactgtctctggtggctccatcagtagtaattactggaactggatccggcagtccccagggaagggactggaatggattggatatatctttcacactggacgcaccaactacagcccctccctcaagagtcgagtcaccacatcagtagacacgtccaagaaccagttctccctgaagctgacttctgtgaccgccgcagacacggccgtgtattactgtgtgagagagaggagggcactaactggggactttgactactggggccagggaaccacggtcaccgtctcctca

SEQ ID NO: 3994 - protein, 119 aa, Artificial Sequence
  synthetic
EVQLVESGPGLVKPSETLSLTCTVSGGSISSNYWNWIRQSPGKGLEWIGYIFHTGRTNYSPSLKSRVTTSVDTSKNQFSLKLTSVTAADTAVYYCVRERRALTGDFDYWGQGTTVTVSS

SEQ ID NO: 3995 - DNA, 24 bp, Artificial Sequence
  synthetic
ggtggctccatcagtagtaattac

SEQ ID NO: 3996 - protein, 8 aa, Artificial Sequence
  synthetic
GGSISSNY

SEQ ID NO: 3997 - DNA, 21 bp, Artificial Sequence
  synthetic
atctttcacactggacgcacc

SEQ ID NO: 3998 - protein, 7 aa, Artificial Sequence
  synthetic
IFHTGRT

SEQ ID NO: 3999 - DNA, 39 bp, Artificial Sequence
  synthetic
gtgagagagaggagggcactaactggggactttgactac

SEQ ID NO: 4000 - protein, 13 aa, Artificial Sequence
  synthetic
VRERRALTGDFDY

SEQ ID NO: 4001 - DNA, 324 bp, Artificial Sequence
  synthetic
gacatccagatgacccagtctccatcctccctgtctgcatctgtaggagacagagtcaccatcacttgccaggcaagtcagagcattagcaggtatttaaattggtatcagcagaaaccagggaaagcccctaaactcctgatctatgctacatccactttgcaaagtggggtcccatcaaggttcagtggcagtggatctgggacagatttcactctcaccatcagcagtctgcaacctgaagatttttcaacttactactgtcagcagagttacagtatcccggtcactttcggcggagggaccaaggtggagatcaaacga

SEQ ID NO: 4002 - protein, 108 aa, Artificial Sequence
  synthetic
DIQMTQSPSSLSASVGDRVTITCQASQSISRYLNWYQQKPGKAPKLLIYATSTLQSGVPSRFSGSGSGTDFTLTISSLQPEDFSTYYCQQSYSIPVTFGGGTKVEIKR

SEQ ID NO: 4003 - DNA, 18 bp, Artificial Sequence
  synthetic
cagagcattagcaggtat

SEQ ID NO: 4004 - protein, 6 aa, Artificial Sequence
  synthetic
QSISRY

SEQ ID NO: 4005 - DNA, 9 bp, Artificial Sequence
  synthetic
gctacatcc

SEQ ID NO: 4006 - protein, 3 aa, Artificial Sequence
  synthetic
ATS

SEQ ID NO: 4007 - DNA, 27 bp, Artificial Sequence
  synthetic
cagcagagttacagtatcccggtcact

SEQ ID NO: 4008 - protein, 9 aa, Artificial Sequence
  synthetic
QQSYSIPVT

SEQ ID NO: 4009 - DNA, 363 bp, Artificial Sequence
  synthetic
caggtgcagctggtgcagtggggcgcaggactgttgaagccttcggagaccctgtccctcacctgtactgtctatggtgggtccttcaattattactactggacctggatccgccagcccccagggaaggggctggagtggattggggaaatcaatcatagtggaagcaccaactacaatccgtccctcaagagtcgagtcaccatatcagtagacacgcccaagaaccagttctccctgaaattgaactctgtgaccgccgcggacacggctgtttattactgtgcgagaggccgaataacagcagctgtctctgatgcttttgatatctggggccaagggacaatggtcaccgtctcctca

SEQ ID NO: 4010 - protein, 121 aa, Artificial Sequence
  synthetic
QVQLVQWGAGLLKPSETLSLTCTVYGGSFNYYYWTWIRQPPGKGLEWIGEINHSGSTNYNPSLKSRVTISVDTPKNQFSLKLNSVTAADTAVYYCARGRITAAVSDAFDIWGQGTMVTVSS

SEQ ID NO: 4011 - DNA, 24 bp, Artificial Sequence
  synthetic
ggtgggtccttcaattattactac

SEQ ID NO: 4012 - protein, 8 aa, Artificial Sequence
  synthetic
GGSFNYYY

SEQ ID NO: 4013 - DNA, 21 bp, Artificial Sequence
  synthetic
atcaatcatagtggaagcacc

SEQ ID NO: 4014 - protein, 7 aa, Artificial Sequence
  synthetic
INHSGST

SEQ ID NO: 4015 - DNA, 45 bp, Artificial Sequence
  synthetic
gcgagaggccgaataacagcagctgtctctgatgcttttgatatc

SEQ ID NO: 4016 - protein, 15 aa, Artificial Sequence
  synthetic
ARGRITAAVSDAFDI

SEQ ID NO: 4017 - DNA, 324 bp, Artificial Sequence
  synthetic
gacatcgtgatgacccagtctccaggcaccctgtctttgtctccaggggaaagagccaccctctcctgcagggccagtcagagtgttagcagcagctacttagcctggtaccagcagaaacctggccaggctcccaggctcctcatctatagtacatccgacagggccactggcatcccagacagattcagtggcagtgggtctgggacagacttcactctcaccatcagcagactggagcctgaagattttgcagtgtattactgtcagcagtatggtgacagattcattttcggccctgggaccaaggtggagatcaaacga

SEQ ID NO: 4018 - protein, 108 aa, Artificial Sequence
  synthetic
DIVMTQSPGTLSLSPGERATLSCRASQSVSSSYLAWYQQKPGQAPRLLIYSTSDRATGIPDRFSGSGSGTDFTLTISRLEPEDFAVYYCQQYGDRFIFGPGTKVEIKR

SEQ ID NO: 4019 - DNA, 21 bp, Artificial Sequence
  synthetic
cagagtgttagcagcagctac

SEQ ID NO: 4020 - protein, 7 aa, Artificial Sequence
  synthetic
QSVSSSY

SEQ ID NO: 4021 - DNA, 9 bp, Artificial Sequence
  synthetic
agtacatcc

SEQ ID NO: 4022 - protein, 3 aa, Artificial Sequence
  synthetic
STS

SEQ ID NO: 4023 - DNA, 24 bp, Artificial Sequence
  synthetic
cagcagtatggtgacagattcatt

SEQ ID NO: 4024 - protein, 8 aa, Artificial Sequence
  synthetic
QQYGDRFI

SEQ ID NO: 4025 - DNA, 363 bp, Artificial Sequence
  synthetic
caggtgcagctgctgcagtggggcgcaggactgttgaagccttcggagaccctgtccctcacctgcgctgtctatggtgggtccttcaactattactactggacctggatccgccagcccccagggaaggggctggagtggattggggaaatcaatcatagtggaagcaccaactacaatccgtccctcaagagtcgagtcaccatatcagtagacacgcccaagaaccagttctccctgaaattgagctctgtgaccgccgcggacacggctgtttattactgtgcgagaggccgaataacagcagctgtctctgatgcttttgatatctggggccaagggacaatggtcaccgtctcttca

SEQ ID NO: 4026 - protein, 121 aa, Artificial Sequence
  synthetic
QVQLLQWGAGLLKPSETLSLTCAVYGGSFNYYYWTWIRQPPGKGLEWIGEINHSGSTNYNPSLKSRVTISVDTPKNQFSLKLSSVTAADTAVYYCARGRITAAVSDAFDIWGQGTMVTVSS

SEQ ID NO: 4027 - DNA, 24 bp, Artificial Sequence
  synthetic
ggtgggtccttcaactattactac

SEQ ID NO: 4028 - protein, 8 aa, Artificial Sequence
  synthetic
GGSFNYYY

SEQ ID NO: 4029 - DNA, 21 bp, Artificial Sequence
  synthetic
atcaatcatagtggaagcacc

SEQ ID NO: 4030 - protein, 7 aa, Artificial Sequence
  synthetic
INHSGST

SEQ ID NO: 4031 - DNA, 45 bp, Artificial Sequence; identical to SEQ ID NO: 4015
  synthetic

SEQ ID NO: 4032 - protein, 15 aa, Artificial Sequence
  synthetic
ARGRITAAVSDAFDI

SEQ ID NO: 4033 - DNA, 324 bp, Artificial Sequence
  synthetic
gacatcgtgatgacccagtctccaggcaccctgtctttgtctccaggggaaagagccaccctctcctgcagggccagtcagagtgttagcagcagttacttagcctggtaccaacagaaacctggccaggctcccaggctcctcatctatggtacatccgacagggccactggcatcccagacagattcagtggcagtgggtccgggacagaattcactctcaccatcagcagactggagcctgaagattttgcagtgtattactgtcagcagtttgatgacagattcattttcggccctgggaccaaggtggagatcaaacga

SEQ ID NO: 4034 - protein, 108 aa, Artificial Sequence
  synthetic
DIVMTQSPGTLSLSPGERATLSCRASQSVSSSYLAWYQQKPGQAPRLLIYGTSDRATGIPDRFSGSGSGTEFTLTISRLEPEDFAVYYCQQFDDRFIFGPGTKVEIKR

SEQ ID NO: 4035 - DNA, 21 bp, Artificial Sequence
  synthetic
cagagtgttagcagcagttac

SEQ ID NO: 4036 - protein, 7 aa, Artificial Sequence
  synthetic
QSVSSSY

SEQ ID NO: 4037 - DNA, 9 bp, Artificial Sequence
  synthetic
ggtacatcc

SEQ ID NO: 4038 - protein, 3 aa, Artificial Sequence
  synthetic
GTS

SEQ ID NO: 4039 - DNA, 24 bp, Artificial Sequence
  synthetic
cagcagtttgatgacagattcatt

SEQ ID NO: 4040 - protein, 8 aa, Artificial Sequence
  synthetic
QQFDDRFI

SEQ ID NO: 4041 - DNA, 360 bp, Artificial Sequence
  synthetic
gaggtgcagctggtggagtctgggggaggcttggtacagcctggggggtccctgagactctcctgtgcagcctctggattcacctttagcacctatgccatgacctgggtccgccaggctccagggaaggggctggagtgggtctcagctattagtggtagtggtcataacacatactatgcagactccgtgaagggccggttcaccatctccagagacaattccaagaacacactgtatctccaaatgaacagcctgagagccgaggacacggccgtatattactgtgcgaaattgggcatagtgggagatactccctttgactactggggccagggaaccatggtcaccgtctcctca

SEQ ID NO: 4042 - protein, 120 aa, Artificial Sequence
  synthetic
EVQLVESGGGLVQPGGSLRLSCAASGFTFSTYAMTWVRQAPGKGLEWVSAISGSGHNTYYADSVKGRFTISRDNSKNTLYLQMNSLRAEDTAVYYCAKLGIVGDTPFDYWGQGTMVTVSS

SEQ ID NO: 4043 - DNA, 24 bp, Artificial Sequence
  synthetic
ggattcacctttagcacctatgcc

SEQ ID NO: 4044 - protein, 8 aa, Artificial Sequence
  synthetic
GFTFSTYA

SEQ ID NO: 4045 - DNA, 24 bp, Artificial Sequence
  synthetic
attagtggtagtggtcataacaca

SEQ ID NO: 4046 - protein, 8 aa, Artificial Sequence
  synthetic
ISGSGHNT

SEQ ID NO: 4047 - DNA, 39 bp, Artificial Sequence; identical to SEQ ID NO: 3887
  synthetic

SEQ ID NO: 4048 - protein, 13 aa, Artificial Sequence
  synthetic
AKLGIVGDTPFDY

SEQ ID NO: 4049 - DNA, 324 bp, Artificial Sequence
  synthetic
gacatcctgatgacccagtctccatcctccctgtctgcatctgtaggagacagagtcaccatcacttgccgggcaagtcagagcatgagcagctatttacattggtatcagcagaaaccagggaaagcccctaaactcctgatctatgctgcatcccgtttgcaaggtggggtcccatccaggttcagtggcagtggatctgggacagatttcactctcaccatcagcagtctgcaacctgaagattttgcatcttactactgtcaacagagtttcagtacccctccgacgttcggccaggggaccaaggtggagatcaaacga

SEQ ID NO: 4050 - protein, 108 aa, Artificial Sequence
  synthetic
DILMTQSPSSLSASVGDRVTITCRASQSMSSYLHWYQQKPGKAPKLLIYAASRLQGGVPSRFSGSGSGTDFTLTISSLQPEDFASYYCQQSFSTPPTFGQGTKVEIKR

SEQ ID NO: 4051 - DNA, 18 bp, Artificial Sequence
  synthetic
cagagcatgagcagctat

SEQ ID NO: 4052 - protein, 6 aa, Artificial Sequence
  synthetic
QSMSSY

SEQ ID NO: 4053 - DNA, 9 bp, Artificial Sequence
  synthetic
gctgcatcc

SEQ ID NO: 4054 - protein, 3 aa, Artificial Sequence
  synthetic
AAS

SEQ ID NO: 4055 - DNA, 27 bp, Artificial Sequence
  synthetic
caacagagtttcagtacccctccgacg

SEQ ID NO: 4056 - protein, 9 aa, Artificial Sequence
  synthetic
QQSFSTPPT

SEQ ID NO: 4057 - DNA, 354 bp, Artificial Sequence
  synthetic
caggtgcagctggtggagtctgggggaggcttggtacagcctggggggtccctgagactctcctgtgcagcctctggattcacctttagcacctttgccatgagctgggtccgccaggctccagggaaggggctggagtgggtctcagctattagttctagtggtgttagcacatactacgcagactccgtgaagggccggttcaccatctccagagacaattccaagaacacgctgtatctgcaaatgaacagcctgagagccgaggacacggccgtatattactgtgcgaaaggcagcagctggtactactttgactactggggccagggaaccctggtcaccgtctcctca

SEQ ID NO: 4058 - protein, 118 aa, Artificial Sequence
  synthetic
QVQLVESGGGLVQPGGSLRLSCAASGFTFSTFAMSWVRQAPGKGLEWVSAISSSGVSTYYADSVKGRFTISRDNSKNTLYLQMNSLRAEDTAVYYCAKGSSWYYFDYWGQGTLVTVSS

SEQ ID NO: 4059 - DNA, 24 bp, Artificial Sequence
  synthetic
ggattcacctttagcacctttgcc

SEQ ID NO: 4060 - protein, 8 aa, Artificial Sequence
  synthetic
GFTFSTFA

SEQ ID NO: 4061 - DNA, 24 bp, Artificial Sequence
  synthetic
attagttctagtggtgttagcaca

SEQ ID NO: 4062 - protein, 8 aa, Artificial Sequence
  synthetic
ISSSGVST

SEQ ID NO: 4063 - DNA, 33 bp, Artificial Sequence; identical to SEQ ID NO: 3967
  synthetic

SEQ ID NO: 4064 - protein, 11 aa, Artificial Sequence
  synthetic
AKGSSWYYFDY

SEQ ID NO: 4065 - DNA, 327 bp, Artificial Sequence; identical to SEQ ID NO: 3969
  synthetic

SEQ ID NO: 4066 - protein, 109 aa, Artificial Sequence; identical to SEQ ID NO: 3970
  synthetic

SEQ ID NO: 4067 - DNA, 21 bp, Artificial Sequence
  synthetic
cagagtgttagcagtagttac

SEQ ID NO: 4068 - protein, 7 aa, Artificial Sequence
  synthetic
QSVSSSY

SEQ ID NO: 4069 - DNA, 9 bp, Artificial Sequence
  synthetic
ggtgcatcc

SEQ ID NO: 4070 - protein, 3 aa, Artificial Sequence
  synthetic
GAS

SEQ ID NO: 4071 - DNA, 27 bp, Artificial Sequence
  synthetic
cagcagtatggtggctcacctcccact

SEQ ID NO: 4072 - protein, 9 aa, Artificial Sequence
  synthetic
QQYGGSPPT

SEQ ID NO: 4073 - DNA, 366 bp, Artificial Sequence
  synthetic
caggtgcagctggtggagtctgggggaggcttggtacagtcgggggggtccctgagactctcctgtgaagcctctggattcacctttatcaactatgccatgaactgggtccgccaggctccagggaaggggctggagtgggtctcagctattgacgttagtggtggtagcacatactacgcagactccgtgaagggccggttcaccatctccagagacaattccaaaaacacactatatctgcaaatgaacagcctgagagccgaggacacggccgtatattactgtgcgaaaccccactccctacgatttgtggagtggtccttggacgtctggggccaagggaccacggtcaccgtctcctca

SEQ ID NO: 4074 - protein, 122 aa, Artificial Sequence
  synthetic
QVQLVESGGGLVQSGGSLRLSCEASGFTFINYAMNWVRQAPGKGLEWVSAIDVSGGSTYYADSVKGRFTISRDNSKNTLYLQMNSLRAEDTAVYYCAKPHSLRFVEWSLDVWGQGTTVTVSS

SEQ ID NO: 4075 - DNA, 24 bp, Artificial Sequence
  synthetic
ggattcacctttatcaactatgcc

SEQ ID NO: 4076 - protein, 8 aa, Artificial Sequence
  synthetic
GFTFINYA

SEQ ID NO: 4077 - DNA, 24 bp, Artificial Sequence
  synthetic
attgacgttagtggtggtagcaca

SEQ ID NO: 4078 - protein, 8 aa, Artificial Sequence
  synthetic
IDVSGGST

SEQ ID NO: 4079 - DNA, 45 bp, Artificial Sequence
  synthetic
gcgaaaccccactccctacgatttgtggagtggtccttggacgtc

SEQ ID NO: 4080 - protein, 15 aa, Artificial Sequence
  synthetic
AKPHSLRFVEWSLDV

SEQ ID NO: 4081 - DNA, 324 bp, Artificial Sequence
  synthetic
gacatcgtgatgacccagtctccatcctccctgtctgcatctgtaggagacagagtcaccatcacttgccgggcaagtcagagcattagcagctatgtgagttggtatcagcagaaaccagggaaagcccctaagctcctgatctatgctgcatcccgtttgcaaagtggggtcccatcaaggttcagtggcagtggatctgggacagatttcactctcaccatcagcagtctgcaacctgaagattttgcaacttactcctgtctacagagttacggtaaccctccgacgttcggccaagggaccaaggtggagatcaaacga

SEQ ID NO: 4082 - protein, 108 aa, Artificial Sequence
  synthetic
DIVMTQSPSSLSASVGDRVTITCRASQSISSYVSWYQQKPGKAPKLLIYAASRLQSGVPSRFSGSGSGTDFTLTISSLQPEDFATYSCLQSYGNPPTFGQGTKVEIKR

SEQ ID NO: 4083 - DNA, 18 bp, Artificial Sequence
  synthetic
cagagcattagcagctat

SEQ ID NO: 4084 - protein, 6 aa, Artificial Sequence
  synthetic
QSISSY

SEQ ID NO: 4085 - DNA, 9 bp, Artificial Sequence
  synthetic
gctgcatcc

SEQ ID NO: 4086 - protein, 3 aa, Artificial Sequence
  synthetic
AAS

SEQ ID NO: 4087 - DNA, 27 bp, Artificial Sequence
  synthetic
ctacagagttacggtaaccctccgacg

SEQ ID NO: 4088 - protein, 9 aa, Artificial Sequence
  synthetic
LQSYGNPPT

SEQ ID NO: 4089 - DNA, 360 bp, Artificial Sequence; identical to SEQ ID NO: 3881
  synthetic

SEQ ID NO: 4090 - protein, 120 aa, Artificial Sequence; identical to SEQ ID NO: 3882
  synthetic

SEQ ID NO: 4091 - DNA, 24 bp, Artificial Sequence
  synthetic
ggattcacctttagcagctatgcc

SEQ ID NO: 4092 - protein, 8 aa, Artificial Sequence
  synthetic
GFTFSSYA

SEQ ID NO: 4093 - DNA, 24 bp, Artificial Sequence
  synthetic
attagtggtagtggtcataacaca

SEQ ID NO: 4094 - protein, 8 aa, Artificial Sequence
  synthetic
ISGSGHNT

SEQ ID NO: 4095 - DNA, 39 bp, Artificial Sequence; identical to SEQ ID NO: 3887
  synthetic

SEQ ID NO: 4096 - protein, 13 aa, Artificial Sequence
  synthetic
AKLGIVGDTPFDY

SEQ ID NO: 4097 - DNA, 324 bp, Artificial Sequence; identical to SEQ ID NO: 3889
  synthetic

SEQ ID NO: 4098 - protein, 108 aa, Artificial Sequence; identical to SEQ ID NO: 3890
  synthetic

SEQ ID NO: 4099 - DNA, 18 bp, Artificial Sequence
  synthetic
cagagcatgagcagctat

SEQ ID NO: 4100 - protein, 6 aa, Artificial Sequence
  synthetic
QSMSSY

SEQ ID NO: 4101 - DNA, 9 bp, Artificial Sequence
  synthetic
gctgcatcc

SEQ ID NO: 4102 - protein, 3 aa, Artificial Sequence
  synthetic
AAS

SEQ ID NO: 4103 - DNA, 27 bp, Artificial Sequence
  synthetic
caacagagtttcagtacccctccgacg

SEQ ID NO: 4104 - protein, 9 aa, Artificial Sequence
  synthetic
QQSFSTPPT

SEQ ID NO: 4105 - DNA, 360 bp, Artificial Sequence
  synthetic
gaggtgcagctggtggagtctgggggaggcttggtacagcctggggggtccctgagactctcctgtacagcctctggattcatctttagcagctatgccataacctgggtccgccaggctccagggacggggctggagtgggtctcagctataagtggtactggtcagaacacatactatgcagactccgtgaagggccggttcaccatctccagagacaattccaagaacattctgtatctccaaatgaacagcctgagagccgaggacacggccgtatattactgtgcgaaattgggcatagtgggagatactccctttgactactggggccagggaaccacggtcaccgtctcctca

SEQ ID NO: 4106 - protein, 120 aa, Artificial Sequence
  synthetic
EVQLVESGGGLVQPGGSLRLSCTASGFIFSSYAITWVRQAPGTGLEWVSAISGTGQNTYYADSVKGRFTISRDNSKNILYLQMNSLRAEDTAVYYCAKLGIVGDTPFDYWGQGTTVTVSS

SEQ ID NO: 4107 - DNA, 24 bp, Artificial Sequence
  synthetic
ggattcatctttagcagctatgcc

SEQ ID NO: 4108 - protein, 8 aa, Artificial Sequence
  synthetic
GFIFSSYA

SEQ ID NO: 4109 - DNA, 24 bp, Artificial Sequence
  synthetic
ataagtggtactggtcagaacaca

SEQ ID NO: 4110 - protein, 8 aa, Artificial Sequence
  synthetic
ISGTGQNT

SEQ ID NO: 4111 - DNA, 39 bp, Artificial Sequence; identical to SEQ ID NO: 3887
  synthetic

SEQ ID NO: 4112 - protein, 13 aa, Artificial Sequence
  synthetic
AKLGIVGDTPFDY

SEQ ID NO: 4113 - DNA, 324 bp, Artificial Sequence
  synthetic
gacatcctgatgacccagtctccatcctccctgtctgcatctgtaggagacagagtcaccatcacttgccgggcaagtcagagcatgagcagctatttacattggtatcagcagagaccagggaaagcccctaagctcctgatctattctgcatccagtttgcagagtggggtcccatccaggttcagtggcagtggatctgggacagatttcactctcaccatcagcagtctgcaacctgaggattttgcaacttactactgtcaacagagttacagtacccctccgacgttcggccaggggaccaaggtggagatcaaacga

SEQ ID NO: 4114 - protein, 108 aa, Artificial Sequence
  synthetic
DILMTQSPSSLSASVGDRVTITCRASQSMSSYLHWYQQRPGKAPKLLIYSASSLQSGVPSRFSGSGSGTDFTLTISSLQPEDFATYYCQQSYSTPPTFGQGTKVEIKR

SEQ ID NO: 4115 - DNA, 18 bp, Artificial Sequence
  synthetic
cagagcatgagcagctat

SEQ ID NO: 4116 - protein, 6 aa, Artificial Sequence
  synthetic
QSMSSY

SEQ ID NO: 4117 - DNA, 9 bp, Artificial Sequence
  synthetic
tctgcatcc

SEQ ID NO: 4118 - protein, 3 aa, Artificial Sequence
  synthetic
SAS

SEQ ID NO: 4119 - DNA, 27 bp, Artificial Sequence
  synthetic
caacagagttacagtacccctccgacg

SEQ ID NO: 4120 - protein, 9 aa, Artificial Sequence
  synthetic
QQSYSTPPT

SEQ ID NO: 4121 - DNA, 366 bp, Artificial Sequence
  synthetic
gaggtgcagctggtggagtcgggcccaggactggtgaagccttcggagaccctgtccctcacctgcactatctctggtggctccatcagtagttactactggagctggatccggctgcccccagggaagggactggagtggattgggtatatctattacagtgggaacaccaactacaacccctccctcaagagtcgagtcaccatatcagtagacacgtccaagaaccagttctccctgaaactgagctctgtgaccgccgcagacacggccgtgtattactgtgcgagagggaaagcagcagctgactactactactacggtatggacgtctggggccaagggaccacggtcaccgtctcctca

SEQ ID NO: 4122 - protein, 122 aa, Artificial Sequence
  synthetic
EVQLVESGPGLVKPSETLSLTCTISGGSISSYYWSWIRLPPGKGLEWIGYIYYSGNTNYNPSLKSRVTISVDTSKNQFSLKLSSVTAADTAVYYCARGKAAADYYYYGMDVWGQGTTVTVSS

SEQ ID NO: 4123 - DNA, 24 bp, Artificial Sequence
  synthetic
ggtggctccatcagtagttactac

SEQ ID NO: 4124 - protein, 8 aa, Artificial Sequence
  synthetic
GGSISSYY

SEQ ID NO: 4125 - DNA, 21 bp, Artificial Sequence
  synthetic
atctattacagtgggaacacc

SEQ ID NO: 4126 - protein, 7 aa, Artificial Sequence
  synthetic
IYYSGNT

SEQ ID NO: 4127 - DNA, 48 bp, Artificial Sequence
  synthetic
gcgagagggaaagcagcagctgactactactactacggtatggacgtc

SEQ ID NO: 4128 - protein, 16 aa, Artificial Sequence
  synthetic
ARGKAAADYYYYGMDV

SEQ ID NO: 4129 - DNA, 342 bp, Artificial Sequence
  synthetic
gacatcctgatgacccagtctccagactccctggctgtgtctctgggcgagagggccaccatcaactgcaagtccagccagagtgttttttacagttccaacaataagaactacttagcttggtaccagcagaaaccaggacagactcctaagctactcatttactgggcatctacccgggaatccggggtccctgaccgattcagtggcagcgggtctgggacagatttcactctcaccatcagcagcctgcaggctgaagatgtggcagtttattactgtcagcaatattataatactccgtggacgttcggccaagggaccaaggtggagatcaaacga

SEQ ID NO: 4130 - protein, 114 aa, Artificial Sequence
  synthetic
DILMTQSPDSLAVSLGERATINCKSSQSVFYSSNNKNYLAWYQQKPGQTPKLLIYWASTRESGVPDRFSGSGSGTDFTLTISSLQAEDVAVYYCQQYYNTPWTFGQGTKVEIKR

SEQ ID NO: 4131 - DNA, 36 bp, Artificial Sequence
  synthetic
cagagtgttttttacagttccaacaataagaactac

SEQ ID NO: 4132 - protein, 12 aa, Artificial Sequence
  synthetic
QSVFYSSNNKNY

SEQ ID NO: 4133 - DNA, 9 bp, Artificial Sequence
  synthetic
tgggcatct

SEQ ID NO: 4134 - protein, 3 aa, Artificial Sequence
  synthetic
WAS

SEQ ID NO: 4135 - DNA, 27 bp, Artificial Sequence
  synthetic
cagcaatattataatactccgtggacg

SEQ ID NO: 4136 - protein, 9 aa, Artificial Sequence
  synthetic
QQYYNTPWT

SEQ ID NO: 4137 - DNA, 363 bp, Artificial Sequence
  synthetic
gaggtgcagctggtggagtctgggggaggcttggtacagcctggagggtccctgagactctcctgtgcatcctctggattcaccctcagtagttatgaagtgaactgggtccgccaggctccagggaaggggctggagtgggtttcatacattagtagaagtagtaccaccatatattacgcagactctgtgaagggccgattcaccatctccagagacaacgccaagaactcactgtatctgcaaatgaacagcctgagagtcgaggacacggctgtttattactgtgcgagagatcgaggctacgtctccgggggtggtatggacgtctggggccaagggaccacggtcaccgtctcctca

SEQ ID NO: 4138 - protein, 121 aa, Artificial Sequence
  synthetic
EVQLVESGGGLVQPGGSLRLSCASSGFTLSSYEVNWVRQAPGKGLEWVSYISRSSTTIYYADSVKGRFTISRDNAKNSLYLQMNSLRVEDTAVYYCARDRGYVSGGGMDVWGQGTTVTVSS

SEQ ID NO: 4139 - DNA, 24 bp, Artificial Sequence
  synthetic
ggattcaccctcagtagttatgaa

SEQ ID NO: 4140 - protein, 8 aa, Artificial Sequence
  synthetic
GFTLSSYE

SEQ ID NO: 4141 - DNA, 24 bp, Artificial Sequence
  synthetic
attagtagaagtagtaccaccata

SEQ ID NO: 4142 - protein, 8 aa, Artificial Sequence
  synthetic
ISRSSTTI

SEQ ID NO: 4143 - DNA, 42 bp, Artificial Sequence; identical to SEQ ID NO: 3903
  synthetic

SEQ ID NO: 4144 - protein, 14 aa, Artificial Sequence
  synthetic
ARDRGYVSGGGMDV

SEQ ID NO: 4145 - DNA, 324 bp, Artificial Sequence
  synthetic
gacatcctgatgacccagtctccatcctccctgtctgcatctgtaggagacagagtcaccatcacttgccgggcaagtcagagcattagcagctatttaaattggtatcagcagaaaccagggaaagcccctaagatcctgatctttgctgcatccagtttgcaaagtggggtcccatcaaggttcagtggcagtggatctgggacagatttcactctcaccatcaccagtctgcaacctgaagattttgcaacttactactgtcaacagacttacaatacccccttcactttcggccctgggaccaaggtggagatcaaacga

SEQ ID NO: 4146 - protein, 108 aa, Artificial Sequence
  synthetic
DILMTQSPSSLSASVGDRVTITCRASQSISSYLNWYQQKPGKAPKILIFAASSLQSGVPSRFSGSGSGTDFTLTITSLQPEDFATYYCQQTYNTPFTFGPGTKVEIKR

SEQ ID NO: 4147 - DNA, 18 bp, Artificial Sequence
  synthetic
cagagcattagcagctat

SEQ ID NO: 4148 - protein, 6 aa, Artificial Sequence
  synthetic
QSISSY

SEQ ID NO: 4149 - DNA, 9 bp, Artificial Sequence
  synthetic
gctgcatcc

SEQ ID NO: 4150 - protein, 3 aa, Artificial Sequence
  synthetic
AAS

SEQ ID NO: 4151 - DNA, 27 bp, Artificial Sequence
  synthetic
caacagacttacaatacccccttcact

SEQ ID NO: 4152 - protein, 9 aa, Artificial Sequence
  synthetic
QQTYNTPFT

SEQ ID NO: 4153 - DNA, 360 bp, Artificial Sequence
  synthetic
gaggtgcagctggtggagtctgggggaggcttggtccagactggggggtccctgagactctcctgttcagcctctggattcacctttagtggctattggatgaactgggtccgccaggctccagggaaggggctggagtgggtgggcaacataaaacaagatggaagtgagaaatactatgtggactctgtgaagggccgattcaccatctccagagacaacgccaagaactcactgtatctgcaaatgaacagcctgagagtcgaggacacggctatttattactgtgcgagagatcatatagtgggagctccttactttgactactggggccagggaaccctggtcaccgtctcctca

SEQ ID NO: 4154 - protein, 120 aa, Artificial Sequence
  synthetic
EVQLVESGGGLVQTGGSLRLSCSASGFTFSGYWMNWVRQAPGKGLEWVGNIKQDGSEKYYVDSVKGRFTISRDNAKNSLYLQMNSLRVEDTAIYYCARDHIVGAPYFDYWGQGTLVTVSS

SEQ ID NO: 4155 - DNA, 24 bp, Artificial Sequence
  synthetic
ggattcacctttagtggctattgg

SEQ ID NO: 4156 - protein, 8 aa, Artificial Sequence
  synthetic
GFTFSGYW

SEQ ID NO: 4157 - DNA, 24 bp, Artificial Sequence
  synthetic
ataaaacaagatggaagtgagaaa

SEQ ID NO: 4158 - protein, 8 aa, Artificial Sequence
  synthetic
IKQDGSEK

SEQ ID NO: 4159 - DNA, 39 bp, Artificial Sequence
  synthetic
gcgagagatcatatagtgggagctccttactttgactac

SEQ ID NO: 4160 - protein, 13 aa, Artificial Sequence
  synthetic
ARDHIVGAPYFDY

SEQ ID NO: 4161 - DNA, 330 bp, Artificial Sequence
  synthetic
gacatcctgatgacccagtctccaacctccctgtctgcatctgtgggagacagagtcaccatcacttgccgggcaagtcagagtattagctactatttaaattggtatcagcagaaaccaggaaaagcccctaaactcctgatctatgctgcatccagtttgcaaagtggggtcccatcaaggttcagtggcagtggatctgggacagatttcactctcaccatcagcagtctgcaacctggagattttgcaacttactactgtcagcagagttacagtatccctccggactacacttttggccaggggaccaaggtggagatcaaacga

SEQ ID NO: 4162 - protein, 110 aa, Artificial Sequence
  synthetic
DILMTQSPTSLSASVGDRVTITCRASQSISYYLNWYQQKPGKAPKLLIYAASSLQSGVPSRFSGSGSGTDFTLTISSLQPGDFATYYCQQSYSIPPDYTFGQGTKVEIKR

SEQ ID NO: 4163 - DNA, 18 bp, Artificial Sequence
  synthetic
cagagtattagctactat

SEQ ID NO: 4164 - protein, 6 aa, Artificial Sequence
  synthetic
QSISYY

SEQ ID NO: 4165 - DNA, 9 bp, Artificial Sequence
  synthetic
gctgcatcc

SEQ ID NO: 4166 - protein, 3 aa, Artificial Sequence
  synthetic
AAS

SEQ ID NO: 4167 - DNA, 33 bp, Artificial Sequence
  synthetic
cagcagagttacagtatccctccggactacact

SEQ ID NO: 4168 - protein, 11 aa, Artificial Sequence
  synthetic
QQSYSIPPDYT

SEQ ID NO: 4169 - DNA, 381 bp, Artificial Sequence
  synthetic
gaggtgcagctggtggagtctgggggaggcttggtacagcctggcaggtccttgagactctcctgtgcagcctctggattcaccttggatgattatggcatgcattgggtccggcaagctccagggaagggcctggaatgggtctcaggtattagttggaatagtggtagtttagactatgcggactctgtgaaggggcgattcaccatctccagagacaacgccaagaactccctgtttctgcaaatgaacagtctgagacctgaggacacggccttgtatttctgtgtaaaagatagagcagtgactacggaagaagatttccactatctcttcggtatggacgtctggggccaagggaccacggtcaccgtctcctca

SEQ ID NO: 4170 - protein, 127 aa, Artificial Sequence
  synthetic
EVQLVESGGGLVQPGRSLRLSCAASGFTLDDYGMHWVRQAPGKGLEWVSGISWNSGSLDYADSVKGRFTISRDNAKNSLFLQMNSLRPEDTALYFCVKDRAVTTEEDFHYLFGMDVWGQGTTVTVSS

SEQ ID NO: 4171 - DNA, 24 bp, Artificial Sequence
  synthetic
ggattcaccttggatgattatggc

SEQ ID NO: 4172 - protein, 8 aa, Artificial Sequence
  synthetic
GFTLDDYG

SEQ ID NO: 4173 - DNA, 24 bp, Artificial Sequence
  synthetic
attagttggaatagtggtagttta

SEQ ID NO: 4174 - protein, 8 aa, Artificial Sequence
  synthetic
ISWNSGSL

SEQ ID NO: 4175 - DNA, 60 bp, Artificial Sequence
  synthetic
gtaaaagatagagcagtgactacggaagaagatttccactatctcttcggtatggacgtc

SEQ ID NO: 4176 - protein, 20 aa, Artificial Sequence
  synthetic
VKDRAVTTEEDFHYLFGMDV

SEQ ID NO: 4177 - DNA, 324 bp, Artificial Sequence
  synthetic
gacatcctgatgacccagtctccatcctccctgtctgcatctgttggagacagagtcaccatcacttgccgggcaagtcagagcattaactggtatttaaattggtatcaacagaaaccagggaaagcccctaaactcctgatctatactgcatccagtttgcaaagtggggtcccatcaaggttcagtggcagtggatctgggacagatttcactctcaccatcagcagtctgcaacctgaagattttgcaacttactactgtcagcagagtttcagtacccctctcacttttggccaggggaccaaggtggagatcaaacga

SEQ ID NO: 4178 - protein, 108 aa, Artificial Sequence
  synthetic
DILMTQSPSSLSASVGDRVTITCRASQSINWYLNWYQQKPGKAPKLLIYTASSLQSGVPSRFSGSGSGTDFTLTISSLQPEDFATYYCQQSFSTPLTFGQGTKVEIKR

SEQ ID NO: 4179 - DNA, 18 bp, Artificial Sequence
  synthetic
cagagcattaactggtat

SEQ ID NO: 4180 - protein, 6 aa, Artificial Sequence
  synthetic
QSINWY

SEQ ID NO: 4181 - DNA, 9 bp, Artificial Sequence
  synthetic
actgcatcc

SEQ ID NO: 4182 - protein, 3 aa, Artificial Sequence
  synthetic
TAS

SEQ ID NO: 4183 - DNA, 27 bp, Artificial Sequence
  synthetic
cagcagagtttcagtacccctctcact

SEQ ID NO: 4184 - protein, 9 aa, Artificial Sequence
  synthetic
QQSFSTPLT

SEQ ID NO: 4185 - DNA, 363 bp, Artificial Sequence
  synthetic
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacataagtagtagtggtagtaacatatactacgcagactctgtgaagggccgatttaccatctccagagacaacgccaagaactcattgtatctgcaaatgaacagcctgagagccgaggacacggctgtttattactgtgcgagagatcgggagggagctacgggggactggttcgacccctggggccagggaaccctggtcaccgtctcctca

SEQ ID NO: 4186 - protein, 121 aa, Artificial Sequence
  synthetic
EVQLVESGGGLVQPGGSLRLSCAASGFTFSSYEMNWVRQAPGKGLEWVSYISSSGSNIYYADSVKGRFTISRDNAKNSLYLQMNSLRAEDTAVYYCARDREGATGDWFDPWGQGTLVTVSS

SEQ ID NO: 4187 - DNA, 24 bp, Artificial Sequence
  synthetic
ggattcaccttcagtagttatgaa

SEQ ID NO: 4188 - protein, 8 aa, Artificial Sequence
  synthetic
GFTFSSYE

SEQ ID NO: 4189 - DNA, 24 bp, Artificial Sequence
  synthetic
ataagtagtagtggtagtaacata

SEQ ID NO: 4190 - protein, 8 aa, Artificial Sequence
  synthetic
ISSSGSNI

SEQ ID NO: 4191 - DNA, 42 bp, Artificial Sequence
  synthetic
gcgagagatcgggagggagctacgggggactggttcgacccc

SEQ ID NO: 4192 - protein, 14 aa, Artificial Sequence
  synthetic
ARDREGATGDWFDP

SEQ ID NO: 4193 - DNA, 324 bp, Artificial Sequence
  synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaaaagtatgataatctcccgtacacttttggccaggggaccaaggtggagatcaaacga

SEQ ID NO: 4194 - protein, 108 aa, Artificial Sequence
  synthetic
DIQMTQSPSSLSASVGDRVTITCQASQDISNYLNWYQQKPGKAPKLLIYDASNLETGVPSRFSGSGSGTDFTFTISSLQPEDIATYYCQKYDNLPYTFGQGTKVEIKR

SEQ ID NO: 4195 - DNA, 18 bp, Artificial Sequence
  synthetic
caggacattagcaactat

SEQ ID NO: 4196 - protein, 6 aa, Artificial Sequence
  synthetic
QDISNY

SEQ ID NO: 4197 - DNA, 9 bp, Artificial Sequence
  synthetic
gatgcatcc

SEQ ID NO: 4198 - protein, 3 aa, Artificial Sequence
  synthetic
DAS

SEQ ID NO: 4199 - DNA, 27 bp, Artificial Sequence
  synthetic
caaaagtatgataatctcccgtacact

SEQ ID NO: 4200 - protein, 9 aa, Artificial Sequence
  synthetic
QKYDNLPYT

SEQ ID NO: 4201 - DNA, 381 bp, Artificial Sequence; identical to SEQ ID NO: 4169
  synthetic

SEQ ID NO: 4202 - protein, 127 aa, Artificial Sequence; identical to SEQ ID NO: 4170
  synthetic

SEQ ID NO: 4203 - DNA, 24 bp, Artificial Sequence
  synthetic
ggattcaccttggatgattatggc

SEQ ID NO: 4204 - protein, 8 aa, Artificial Sequence
  synthetic
GFTLDDYG

SEQ ID NO: 4205 - DNA, 24 bp, Artificial Sequence
  synthetic
attagttggaatagtggtagttta

SEQ ID NO: 4206 - protein, 8 aa, Artificial Sequence
  synthetic
ISWNSGSL

SEQ ID NO: 4207 - DNA, 60 bp, Artificial Sequence; identical to SEQ ID NO: 4175
  synthetic

SEQ ID NO: 4208 - protein, 20 aa, Artificial Sequence
  synthetic
VKDRAVTTEEDFHYLFGMDV

SEQ ID NO: 4209 - DNA, 324 bp, Artificial Sequence; identical to SEQ ID NO: 4177
  synthetic

SEQ ID NO: 4210 - protein, 108 aa, Artificial Sequence; identical to SEQ ID NO: 4178
  synthetic

SEQ ID NO: 4211 - DNA, 18 bp, Artificial Sequence
  synthetic
cagagcattaactggtat

SEQ ID NO: 4212 - protein, 6 aa, Artificial Sequence
  synthetic
QSINWY

SEQ ID NO: 4213 - DNA, 9 bp, Artificial Sequence
  synthetic
actgcatcc

SEQ ID NO: 4214 - protein, 3 aa, Artificial Sequence
  synthetic
TAS

SEQ ID NO: 4215 - DNA, 27 bp, Artificial Sequence
  synthetic
cagcagagtttcagtacccctctcact

SEQ ID NO: 4216 - protein, 9 aa, Artificial Sequence
  synthetic
QQSFSTPLT

SEQ ID NO: 4217 - DNA, 360 bp, Artificial Sequence
  synthetic
caggtgcagctggtggagtctgggggaggcttggtacagtttggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgacgacacggccgtatattactgtgcgaagatagcagtgactggtacgtccccctttgactactggggccagggaaccctggtcaccgtctcctca

SEQ ID NO: 4218 - protein, 120 aa, Artificial Sequence
  synthetic
QVQLVESGGGLVQFGGSLRLSCAASGFTFSSYAMSWVRQAPGKGLEWVSAISGSGGSTYYADSVKGRFTISRDNSKNTLYLQMNSLRADDTAVYYCAKIAVTGTSPFDYWGQGTLVTVSS

SEQ ID NO: 4219 - DNA, 24 bp, Artificial Sequence
  synthetic
ggattcacctttagcagctatgcc

SEQ ID NO: 4220 - protein, 8 aa, Artificial Sequence
  synthetic
GFTFSSYA

SEQ ID NO: 4221 - DNA, 24 bp, Artificial Sequence
  synthetic
attagtggtagtggtggtagcaca

SEQ ID NO: 4222 - protein, 8 aa, Artificial Sequence
  synthetic
ISGSGGST

SEQ ID NO: 4223 - DNA, 39 bp, Artificial Sequence
  synthetic
gcgaagatagcagtgactggtacgtccccctttgactac

SEQ ID NO: 4224 - protein, 13 aa, Artificial Sequence
  synthetic
AKIAVTGTSPFDY

SEQ ID NO: 4225 - DNA, 324 bp, Artificial Sequence
  synthetic
gacatccagatgacccagtctccatcctccctgtcttcatctgtaggagacagagtcaccatcacttgccgggcaagtcagagcattagctcctatttaaactggtatcagaagaaaccagggaaagcccctaaactcctgatctatgctgcatccagtttgcaacgtggggtcccatcaaggttcagtggcagtggatctgggacaaatttcactctcaccatcagcagtctgcaacctgaatattttgcaacttactactgtcaacagacttacactacccctccgacgttcggccaagggaccaaggtggagatcaaacga

SEQ ID NO: 4226 - protein, 108 aa, Artificial Sequence
  synthetic
DIQMTQSPSSLSSSVGDRVTITCRASQSISSYLNWYQKKPGKAPKLLIYAASSLQRGVPSRFSGSGSGTNFTLTISSLQPEYFATYYCQQTYTTPPTFGQGTKVEIKR

SEQ ID NO: 4227 - DNA, 18 bp, Artificial Sequence
  synthetic
cagagcattagctcctat

SEQ ID NO: 4228 - protein, 6 aa, Artificial Sequence
  synthetic
QSISSY

SEQ ID NO: 4229 - DNA, 9 bp, Artificial Sequence
  synthetic
gctgcatcc

SEQ ID NO: 4230 - protein, 3 aa, Artificial Sequence
  synthetic
AAS

SEQ ID NO: 4231 - DNA, 27 bp, Artificial Sequence
  synthetic
caacagacttacactacccctccgacg

SEQ ID NO: 4232 - protein, 9 aa, Artificial Sequence
  synthetic
QQTYTTPPT

SEQ ID NO: 4233 - DNA, 381 bp, Artificial Sequence
  synthetic
caggtgcagctggtggagtctgggggaggcttggtacagcctggcaggtccctgagactctcctgtgcagcctctggattcacctttgatgattatgacatgcactgggtccggcaagctccagggaagggcctggagtgggtctcaggtattagttggaatagtggtagcttaggctatgcggactctgtgaagggccgattcaccatctccagagacaacgccaataactccctgtatctgcaaatgaacagtctgagacctgaggacacggccctgtattactgtgcgaaacatagaacagtaactacggaagagattttctactactactttggtatggacgtctggggccaagggaccacggtcaccgtctcctca

SEQ ID NO: 4234 - protein, 127 aa, Artificial Sequence
  synthetic
QVQLVESGGGLVQPGRSLRLSCAASGFTFDDYDMHWVRQAPGKGLEWVSGISWNSGSLGYADSVKGRFTISRDNANNSLYLQMNSLRPEDTALYYCAKHRTVTTEEIFYYYFGMDVWGQGTTVTVSS

SEQ ID NO: 4235 - DNA, 24 bp, Artificial Sequence
  synthetic
ggattcacctttgatgattatgac

SEQ ID NO: 4236 - protein, 8 aa, Artificial Sequence
  synthetic
GFTFDDYD

SEQ ID NO: 4237 - DNA, 24 bp, Artificial Sequence
  synthetic
attagttggaatagtggtagctta

SEQ ID NO: 4238 - protein, 8 aa, Artificial Sequence
  synthetic
ISWNSGSL

SEQ ID NO: 4239 - DNA, 60 bp, Artificial Sequence
  synthetic
gcgaaacatagaacagtaactacggaagagattttctactactactttggtatggacgtc

SEQ ID NO: 4240 - protein, 20 aa, Artificial Sequence
  synthetic
AKHRTVTTEEIFYYYFGMDV

SEQ ID NO: 4241 - DNA, 324 bp, Artificial Sequence
  synthetic
gacatccagatgacccagtctccatcctccctgtctgcatctgtaggagacagagtcaccttcacttgccgggcaagtcagagcattggcaactatttaaattggtatcagcagaaaccagggaaagcccctaagctcctgatctattctgcatccagtttgcaaagtggggtcccatcaagattcagtggcagtggatctgggacagatttcagtctcaccatcagcagtctgcagcctgaagattttgcaacttactactgtcaacagagtttcaatgtccctcccacttttggccaggggaccaaggtggagatcaaacga

SEQ ID NO: 4242 - protein, 108 aa, Artificial Sequence
  synthetic
DIQMTQSPSSLSASVGDRVTFTCRASQSIGNYLNWYQQKPGKAPKLLIYSASSLQSGVPSRFSGSGSGTDFSLTISSLQPEDFATYYCQQSFNVPPTFGQGTKVEIKR

SEQ ID NO: 4243 - DNA, 18 bp, Artificial Sequence
  synthetic
cagagcattggcaactat

SEQ ID NO: 4244 - protein, 6 aa, Artificial Sequence
  synthetic
QSIGNY

SEQ ID NO: 4245 - DNA, 9 bp, Artificial Sequence
  synthetic
tctgcatcc

SEQ ID NO: 4246 - protein, 3 aa, Artificial Sequence
  synthetic
SAS

SEQ ID NO: 4247 - DNA, 27 bp, Artificial Sequence
  synthetic
caacagagtttcaatgtccctcccact

SEQ ID NO: 4248 - protein, 9 aa, Artificial Sequence
  synthetic
QQSFNVPPT

SEQ ID NO: 4249 - DNA, 387 bp, Artificial Sequence
  synthetic
gaggtgcagctggtggagtctgggggaggtgtggttcggccgggggggtccctgagactctcctgtgcagcctctggattcacctttgatgattatgacctgatctgggtccgccaagctccagggaaggggctggagtgggtctctggtattaattggaatggcgaaatcacaggttatgcagactctgtgaagggccgattcaccatatccagagacaaagccaagaactccctgtatctgcaaatgcacagtctgagagccgaggattcggccttgtatttttgtgcgagagaaggatgtagtagtaccagctgctttccatattactacccctacttcggtatggacgtctggggccaagggaccacggtcaccgtctcctca

SEQ ID NO: 4250 - protein, 129 aa, Artificial Sequence
  synthetic
EVQLVESGGGVVRPGGSLRLSCAASGFTFDDYDLIWVRQAPGKGLEWVSGINWNGEITGYADSVKGRFTISRDKAKNSLYLQMHSLRAEDSALYFCAREGCSSTSCFPYYYPYFGMDVWGQGTTVTVSS

SEQ ID NO: 4251 - DNA, 24 bp, Artificial Sequence
  synthetic
ggattcacctttgatgattatgac

SEQ ID NO: 4252 - protein, 8 aa, Artificial Sequence
  synthetic
GFTFDDYD

SEQ ID NO: 4253 - DNA, 24 bp, Artificial Sequence
  synthetic
attaattggaatggcgaaatcaca

SEQ ID NO: 4254 - protein, 8 aa, Artificial Sequence
  synthetic
INWNGEIT

SEQ ID NO: 4255 - DNA, 66 bp, Artificial Sequence
  synthetic
gcgagagaaggatgtagtagtaccagctgctttccatattactacccctacttcggtatggacgtc

SEQ ID NO: 4256 - protein, 22 aa, Artificial Sequence
  synthetic
AREGCSSTSCFPYYYPYFGMDV

SEQ ID NO: 4257 - DNA, 339 bp, Artificial Sequence
  synthetic
gacatcgtgatgacccagtctccactctccctgcccgtcacccctggagagccggcctccatctcctgtaggtctagtcagagcctcctgcatagtaatggagacaactatttggattggtacctacagaagccagggcagtctccacaactcctgatctttttgaattctaatcgggcctccggggtccctgacaggttcagtggcagtggatcaggtacagattttacactgaaaatcaacacagtggaggctgaggatgttgggatttattactgcatgcaggctctacaaactccgtggacgttcggccaagggaccaaggtggagatcaaacga

SEQ ID NO: 4258 - protein, 113 aa, Artificial Sequence
  synthetic
DIVMTQSPLSLPVTPGEPASISCRSSQSLLHSNGDNYLDWYLQKPGQSPQLLIFLNSNRASGVPDRFSGSGSGTDFTLKINTVEAEDVGIYYCMQALQTPWTFGQGTKVEIKR

SEQ ID NO: 4259 - DNA, 33 bp, Artificial Sequence
  synthetic
cagagcctcctgcatagtaatggagacaactat

SEQ ID NO: 4260 - protein, 11 aa, Artificial Sequence
  synthetic
QSLLHSNGDNY

SEQ ID NO: 4261 - DNA, 9 bp, Artificial Sequence
  synthetic
ttgaattct

SEQ ID NO: 4262 - protein, 3 aa, Artificial Sequence
  synthetic
LNS

SEQ ID NO: 4263 - DNA, 27 bp, Artificial Sequence
  synthetic
atgcaggctctacaaactccgtggacg

SEQ ID NO: 4264 - protein, 9 aa, Artificial Sequence
  synthetic
MQALQTPWT

SEQ ID NO: 4265 - DNA, 360 bp, Artificial Sequence
  synthetic
gaggtgcagctggtggagtctgggggaggcttggtccagcctggggagtccctgagactctcctgtgcagcctctggattcatctttagtacctattggatgaactgggtccgtcaggctccagggaaggggctggagtgggtggccaacataaagcaagatggaagtgagaagtactatgtggactctgtgaagggccgattcaccatctccagagacaacgccaagaactcactgtctctgcaaatgagtagcctgagagccgaggacacggctgtttattactgtgcgagagatcatattgtgggagctccttactttgactactggggccagggaaccctggtcaccgtctcctca

SEQ ID NO: 4266 - protein, 120 aa, Artificial Sequence
  synthetic
EVQLVESGGGLVQPGESLRLSCAASGFIFSTYWMNWVRQAPGKGLEWVANIKQDGSEKYYVDSVKGRFTISRDNAKNSLSLQMSSLRAEDTAVYYCARDHIVGAPYFDYWGQGTLVTVSS

SEQ ID NO: 4267 - DNA, 24 bp, Artificial Sequence
  synthetic
ggattcatctttagtacctattgg

SEQ ID NO: 4268 - protein, 8 aa, Artificial Sequence
  synthetic
GFIFSTYW

SEQ ID NO: 4269 - DNA, 24 bp, Artificial Sequence
  synthetic
ataaagcaagatggaagtgagaag

SEQ ID NO: 4270 - protein, 8 aa, Artificial Sequence
  synthetic
IKQDGSEK

SEQ ID NO: 4271 - DNA, 39 bp, Artificial Sequence
  synthetic
gcgagagatcatattgtgggagctccttactttgactac

SEQ ID NO: 4272 - protein, 13 aa, Artificial Sequence
  synthetic
ARDHIVGAPYFDY

SEQ ID NO: 4273 - DNA, 330 bp, Artificial Sequence
  synthetic
gacatccagatgacccagtctccatcctccctgtctgcatctgtaggagacagagtcaccatcacttgccgggcaagtcagagcattagttactatttaaattggtatcagcagaaaccagggaaagcccctaagctcctgatctatggtgcatccagtttgcaaagtggggtcccatcaaggttcagtggcagtggatctgggacagatttcactctcaccatcagcagtctgcaacctgaagattttgtaatttactactgtcaacagagttacagtatccctccggagtacacttttggccaggggaccaaggtggagatcaaacga

SEQ ID NO: 4274 - protein, 110 aa, Artificial Sequence
  synthetic
DIQMTQSPSSLSASVGDRVTITCRASQSISYYLNWYQQKPGKAPKLLIYGASSLQSGVPSRFSGSGSGTDFTLTISSLQPEDFVIYYCQQSYSIPPEYTFGQGTKVEIKR

SEQ ID NO: 4275 - DNA, 18 bp, Artificial Sequence
  synthetic
cagagcattagttactat

SEQ ID NO: 4276 - protein, 6 aa, Artificial Sequence
  synthetic
QSISYY

SEQ ID NO: 4277 - DNA, 9 bp, Artificial Sequence
  synthetic
ggtgcatcc

SEQ ID NO: 4278 - protein, 3 aa, Artificial Sequence
  synthetic
GAS

SEQ ID NO: 4279 - DNA, 33 bp, Artificial Sequence
  synthetic
caacagagttacagtatccctccggagtacact

SEQ ID NO: 4280 - protein, 11 aa, Artificial Sequence
  synthetic
QQSYSIPPEYT

SEQ ID NO: 4281 - DNA, 369 bp, Artificial Sequence
  synthetic
gaggtgcagctggtggagtcgggcccaggactggtgaagccttcggagaccctgtccctcacctgcactatctctggtggctccatcagtacttactactggaactggatccggcagcccccagggaagggactggaatggattgggcatatcttttatagtgggaccaccaactacaacccctccctcaggagtcgagtcaccatatcagtagacacgtccaagaatcagttatccctgaagctgagctctgtgaccgctgcggacacggccttttattcctgtgcgagagagaggggcggggtaaccgacggtgactacggcgggttcgacccctggggccagggaaccctggtcaccgtctcctca

SEQ ID NO: 4282 - protein, 123 aa, Artificial Sequence
  synthetic
EVQLVESGPGLVKPSETLSLTCTISGGSISTYYWNWIRQPPGKGLEWIGHIFYSGTTNYNPSLRSRVTISVDTSKNQLSLKLSSVTAADTAFYSCARERGGVTDGDYGGFDPWGQGTLVTVSS

SEQ ID NO: 4283 - DNA, 24 bp, Artificial Sequence
  synthetic
ggtggctccatcagtacttactac

SEQ ID NO: 4284 - protein, 8 aa, Artificial Sequence
  synthetic
GGSISTYY

SEQ ID NO: 4285 - DNA, 21 bp, Artificial Sequence
  synthetic
atcttttatagtgggaccacc

SEQ ID NO: 4286 - protein, 7 aa, Artificial Sequence
  synthetic
IFYSGTT

SEQ ID NO: 4287 - DNA, 51 bp, Artificial Sequence
  synthetic
gcgagagagaggggcggggtaaccgacggtgactacggcgggttcgacccc

SEQ ID NO: 4288 - protein, 17 aa, Artificial Sequence
  synthetic
ARERGGVTDGDYGGFDP

SEQ ID NO: 4289 - DNA, 324 bp, Artificial Sequence
  synthetic
gacatccagatgacccagtctccatcctccctgtctgcatctgtaggagacagagtcagtatcacttgccgggcaagtcagatcattagcacctatttaaattggtatcagcagaaaccagggaaagcccctaacctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtgcccctcggacgttcggccaagggaccaaggtggagatcaaacga

SEQ ID NO: 4290 - protein, 108 aa, Artificial Sequence
  synthetic
DIQMTQSPSSLSASVGDRVSITCRASQIISTYLNWYQQKPGKAPNLLIYAASSLQSGVPSRFSGSGSGTDFTLTISSLQPEDFATYYCQQSYSAPRTFGQGTKVEIKR

SEQ ID NO: 4291 - DNA, 18 bp, Artificial Sequence
  synthetic
cagatcattagcacctat

SEQ ID NO: 4292 - protein, 6 aa, Artificial Sequence
  synthetic
QIISTY

SEQ ID NO: 4293 - DNA, 9 bp, Artificial Sequence
  synthetic
gctgcatcc

SEQ ID NO: 4294 - protein, 3 aa, Artificial Sequence
  synthetic
AAS

SEQ ID NO: 4295 - DNA, 27 bp, Artificial Sequence
  synthetic
caacagagttacagtgcccctcggacg

SEQ ID NO: 4296 - protein, 9 aa, Artificial Sequence
  synthetic
QQSYSAPRT

SEQ ID NO: 4297 - DNA, 369 bp, Artificial Sequence
  synthetic
gaggtgcagctggtggagtcgggcccaggactggtgaagccttcggagaccctgtccctcacctgcactgtctctggtggctccatcagtacttactactggaactggatccggcagtccccagggaagggactggagtggattgggaatatcaattacagtgggagtaccaactacaacccctccctcaagagtcgagtcaccatatcagtagacacgtccaggaaccagttctccctgaagttgagttttgtgaccgctgcggacacggccgtgtttttctgtgcgagagagaggggcgggtttaccgacactgactacggcggattcgacccctggggccagggaaccctggtcaccgtctcctca

SEQ ID NO: 4298 - protein, 123 aa, Artificial Sequence
  synthetic
EVQLVESGPGLVKPSETLSLTCTVSGGSISTYYWNWIRQSPGKGLEWIGNINYSGSTNYNPSLKSRVTISVDTSRNQFSLKLSFVTAADTAVFFCARERGGFTDTDYGGFDPWGQGTLVTVSS

SEQ ID NO: 4299 - DNA, 24 bp, Artificial Sequence
  synthetic
ggtggctccatcagtacttactac

SEQ ID NO: 4300 - protein, 8 aa, Artificial Sequence
  synthetic
GGSISTYY

SEQ ID NO: 4301 - DNA, 21 bp, Artificial Sequence
  synthetic
atcaattacagtgggagtacc

SEQ ID NO: 4302 - protein, 7 aa, Artificial Sequence
  synthetic
INYSGST

SEQ ID NO: 4303 - DNA, 51 bp, Artificial Sequence
  synthetic
gcgagagagaggggcgggtttaccgacactgactacggcggattcgacccc

SEQ ID NO: 4304 - protein, 17 aa, Artificial Sequence
  synthetic
ARERGGFTDTDYGGFDP

SEQ ID NO: 4305 - DNA, 324 bp, Artificial Sequence
  synthetic
gacatcctgatgacccagtctccatcctccctgtctgcatctgtaggagacagagtctccatcacttgccgggcaagtcagagcattagtagttatttaaattggtatcagcagaaaccagggaaagcccctaacctcctgatctatgctgcatccaatttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggagatcaaacga

SEQ ID NO: 4306 - protein, 108 aa, Artificial Sequence
  synthetic
DILMTQSPSSLSASVGDRVSITCRASQSISSYLNWYQQKPGKAPNLLIYAASNLQSGVPSRFSGSGSGTDFTLTISSLQPEDFATYYCQQSYSTPRTFGQGTKVEIKR

SEQ ID NO: 4307 - DNA, 18 bp, Artificial Sequence
  synthetic
cagagcattagtagttat

SEQ ID NO: 4308 - protein, 6 aa, Artificial Sequence
  synthetic
QSISSY

SEQ ID NO: 4309 - DNA, 9 bp, Artificial Sequence
  synthetic
gctgcatcc

SEQ ID NO: 4310 - protein, 3 aa, Artificial Sequence
  synthetic
AAS

SEQ ID NO: 4311 - DNA, 27 bp, Artificial Sequence
  synthetic
caacagagttacagtacccctcggacg

SEQ ID NO: 4312 - protein, 9 aa, Artificial Sequence
  synthetic
QQSYSTPRT

SEQ ID NO: 4313 - DNA, 387 bp, Artificial Sequence
  synthetic
gaggtgcagctggtggagtctgggggaggtgtggtacggccgggggggtccctgagactctcctgtgcagcctctggattcacctttgctgattatgacatgacctgggtccgccaagctccagggaaggggctggaatgggtctctggtattaattggaatggtgatatcacaggttatgcagactctgtgaggggccgattcaccatctccagagacaacgccaagaactccctgtatctgcaaatgaacagtctgagagccgaggacacggccttatatcactgtgcgagagagggatgtagtagtaccagctgctttccatattactatccctacttcggtttggacgtctggggccaagggaccacggtcaccgtctcctca

SEQ ID NO: 4314 - protein, 129 aa, Artificial Sequence
  synthetic
EVQLVESGGGVVRPGGSLRLSCAASGFTFADYDMTWVRQAPGKGLEWVSGINWNGDITGYADSVRGRFTISRDNAKNSLYLQMNSLRAEDTALYHCAREGCSSTSCFPYYYPYFGLDVWGQGTTVTVSS

SEQ ID NO: 4315 - DNA, 24 bp, Artificial Sequence
  synthetic
ggattcacctttgctgattatgac

SEQ ID NO: 4316 - protein, 8 aa, Artificial Sequence
  synthetic
GFTFADYD

SEQ ID NO: 4317 - DNA, 24 bp, Artificial Sequence
  synthetic
attaattggaatggtgatatcaca

SEQ ID NO: 4318 - protein, 8 aa, Artificial Sequence
  synthetic
INWNGDIT

SEQ ID NO: 4319 - DNA, 66 bp, Artificial Sequence
  synthetic
gcgagagagggatgtagtagtaccagctgctttccatattactatccctacttcggtttggacgtc

SEQ ID NO: 4320 - protein, 22 aa, Artificial Sequence
  synthetic
AREGCSSTSCFPYYYPYFGLDV

SEQ ID NO: 4321 - DNA, 324 bp, Artificial Sequence
  synthetic
gacatcctgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaggtggagatcaaacga

SEQ ID NO: 4322 - protein, 108 aa, Artificial Sequence
  synthetic
DILMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR

SEQ ID NO: 4323 - DNA, 18 bp, Artificial Sequence
  synthetic
cagagcattagcagctat

SEQ ID NO: 4324 - protein, 6 aa, Artificial Sequence
  synthetic
QSISSY

SEQ ID NO: 4325 - DNA, 9 bp, Artificial Sequence
  synthetic
gctgcatcc

SEQ ID NO: 4326 - protein, 3 aa, Artificial Sequence
  synthetic
AAS

SEQ ID NO: 4327 - DNA, 27 bp, Artificial Sequence
  synthetic
caacagagttacagtaccccgctcact

SEQ ID NO: 4328 - protein, 9 aa, Artificial Sequence
  synthetic
QQSYSTPLT

SEQ ID NO: 4329 - DNA, 363 bp, Artificial Sequence
  synthetic
gaggtgcagctggtggagtctgggggaggcttggtacagcctggggggtccctgagactctcctgtgcagcctctggattcacctttagcacctatgccataacctgggtccgccaggctccagggaaggggctggagtgggtctcagctattagtggtagtggtggtaacacatactacgcagacttcgtgaagggccggttcaccatctccagagacaattccaagaacacgctgtatctgcaaatgaacagcctgagagccgaggacacggccgtatattactgtgcgactctggatatagtggctacgtcccatgcttttgatatctggggccaagggacaatggtcaccgtctcttca

SEQ ID NO: 4330 - protein, 121 aa, Artificial Sequence
  synthetic
EVQLVESGGGLVQPGGSLRLSCAASGFTFSTYAITWVRQAPGKGLEWVSAISGSGGNTYYADFVKGRFTISRDNSKNTLYLQMNSLRAEDTAVYYCATLDIVATSHAFDIWGQGTMVTVSS

SEQ ID NO: 4331 - DNA, 24 bp, Artificial Sequence
  synthetic
ggattcacctttagcacctatgcc

SEQ ID NO: 4332 - protein, 8 aa, Artificial Sequence
  synthetic
GFTFSTYA

SEQ ID NO: 4333 - DNA, 24 bp, Artificial Sequence
  synthetic
attagtggtagtggtggtaacaca

SEQ ID NO: 4334 - protein, 8 aa, Artificial Sequence
  synthetic
ISGSGGNT

SEQ ID NO: 4335 - DNA, 42 bp, Artificial Sequence
  synthetic
gcgactctggatatagtggctacgtcccatgcttttgatatc

SEQ ID NO: 4336 - protein, 14 aa, Artificial Sequence
  synthetic
ATLDIVATSHAFDI

SEQ ID NO: 4337 - DNA, 324 bp, Artificial Sequence
  synthetic
gacatccagatgacccagtctccatcctccctgtctgcatctgtaggagacagagtcaccatcacttgccgggcaagtcagagcattagcacctatttacattggtatcagcagaaaccagggaaagcccctaagctcctgatctatgctgcatccagtttgcaaagtggggtcccatcaaggttcagtggcaatggatctgggacagatttcactctcaccatcagcagtctgcaacctgaagattttgcaacttactactgtcaacagagttacagtacccctcccactttcggcggagggaccaaggtggagatcaaacga

SEQ ID NO: 4338 - protein, 108 aa, Artificial Sequence
  synthetic
DIQMTQSPSSLSASVGDRVTITCRASQSISTYLHWYQQKPGKAPKLLIYAASSLQSGVPSRFSGNGSGTDFTLTISSLQPEDFATYYCQQSYSTPPTFGGGTKVEIKR

SEQ ID NO: 4339 - DNA, 18 bp, Artificial Sequence
  synthetic
cagagcattagcacctat

SEQ ID NO: 4340 - protein, 6 aa, Artificial Sequence
  synthetic
QSISTY

SEQ ID NO: 4341 - DNA, 9 bp, Artificial Sequence
  synthetic
gctgcatcc

SEQ ID NO: 4342 - protein, 3 aa, Artificial Sequence
  synthetic
AAS

SEQ ID NO: 4343 - DNA, 27 bp, Artificial Sequence
  synthetic
caacagagttacagtacccctcccact

SEQ ID NO: 4344 - protein, 9 aa, Artificial Sequence
  synthetic
QQSYSTPPT

SEQ ID NO: 4345 - DNA, 381 bp, Artificial Sequence; identical to SEQ ID NO: 4169
  synthetic

SEQ ID NO: 4346 - protein, 127 aa, Artificial Sequence; identical to SEQ ID NO: 4170
  synthetic

SEQ ID NO: 4347 - DNA, 24 bp, Artificial Sequence
  synthetic
ggattcaccttggatgattatggc

SEQ ID NO: 4348 - protein, 8 aa, Artificial Sequence
  synthetic
GFTLDDYG

SEQ ID NO: 4349 - DNA, 24 bp, Artificial Sequence
  synthetic
attagttggaatagtggtagttta

SEQ ID NO: 4350 - protein, 8 aa, Artificial Sequence
  synthetic
ISWNSGSL

SEQ ID NO: 4351 - DNA, 60 bp, Artificial Sequence; identical to SEQ ID NO: 4175
  synthetic

SEQ ID NO: 4352 - protein, 20 aa, Artificial Sequence
  synthetic
VKDRAVTTEEDFHYLFGMDV

SEQ ID NO: 4353 - DNA, 324 bp, Artificial Sequence; identical to SEQ ID NO: 4177
  synthetic

SEQ ID NO: 4354 - protein, 108 aa, Artificial Sequence; identical to SEQ ID NO: 4178
  synthetic

SEQ ID NO: 4355 - DNA, 18 bp, Artificial Sequence
  synthetic
cagagcattaactggtat

SEQ ID NO: 4356 - protein, 6 aa, Artificial Sequence
  synthetic
QSINWY

SEQ ID NO: 4357 - DNA, 9 bp, Artificial Sequence
  synthetic
actgcatcc

SEQ ID NO: 4358 - protein, 3 aa, Artificial Sequence
  synthetic
TAS

SEQ ID NO: 4359 - DNA, 27 bp, Artificial Sequence
  synthetic
cagcagagtttcagtacccctctcact

SEQ ID NO: 4360 - protein, 9 aa, Artificial Sequence
  synthetic
QQSFSTPLT

SEQ ID NO: 4361 - DNA, 381 bp, Artificial Sequence
  synthetic
gaggtgcagctggtggagtctgggggaggtttggtacagcctggcaggtccctgagactctcctgtgcagcctctggattcacctttgatgaatatgacatgcactgggtccggcaagctccagggaagggcctggagtgggtctcaggtattagttggaatagtggtaacataggctatgcggactctgtgaagggccgattcaccatgtccagagacaacgccaagaactccctgtatctggaaatgaacagtctgagacctgaggacacggccttgtattactgtgcaaaacatagagcaataactacggaagagattttctactactactatggtatggacgtctggggccaagggaccacggtcaccgtctcctca

SEQ ID NO: 4362 - protein, 127 aa, Artificial Sequence
  synthetic
EVQLVESGGGLVQPGRSLRLSCAASGFTFDEYDMHWVRQAPGKGLEWVSGISWNSGNIGYADSVKGRFTMSRDNAKNSLYLEMNSLRPEDTALYYCAKHRAITTEEIFYYYYGMDVWGQGTTVTVSS

SEQ ID NO: 4363 - DNA, 24 bp, Artificial Sequence
  synthetic
ggattcacctttgatgaatatgac

SEQ ID NO: 4364 - protein, 8 aa, Artificial Sequence
  synthetic
GFTFDEYD

SEQ ID NO: 4365 - DNA, 24 bp, Artificial Sequence
  synthetic
attagttggaatagtggtaacata

SEQ ID NO: 4366 - protein, 8 aa, Artificial Sequence
  synthetic
ISWNSGNI

SEQ ID NO: 4367 - DNA, 60 bp, Artificial Sequence
  synthetic
gcaaaacatagagcaataactacggaagagattttctactactactatggtatggacgtc

SEQ ID NO: 4368 - protein, 20 aa, Artificial Sequence
  synthetic
AKHRAITTEEIFYYYYGMDV

SEQ ID NO: 4369 - DNA, 324 bp, Artificial Sequence
  synthetic
gacatccagatgacccagtctccatcctccctgtctgcatctgtaggagacagagtcaccttcacttgccgggcaagtcagagcattagcagttatttaaattggtatcagcagaaaccagggaaagcccctaaactcctgatctatgctgcatccagtttgcaaagtggggtcccatcaaggttcagtggcagtggatctgggacagatttcactctcaccatcagcagtctgcagcctgaagattttgcaacttactactgtcaacagagttacagtatccctcccacttttggccaggggaccaaggtggagatcaaacga

SEQ ID NO: 4370 - protein, 108 aa, Artificial Sequence
  synthetic
DIQMTQSPSSLSASVGDRVTFTCRASQSISSYLNWYQQKPGKAPKLLIYAASSLQSGVPSRFSGSGSGTDFTLTISSLQPEDFATYYCQQSYSIPPTFGQGTKVEIKR

SEQ ID NO: 4371 - DNA, 18 bp, Artificial Sequence
  synthetic
cagagcattagcagttat

SEQ ID NO: 4372 - protein, 6 aa, Artificial Sequence
  synthetic
QSISSY

SEQ ID NO: 4373 - DNA, 9 bp, Artificial Sequence
  synthetic
gctgcatcc

SEQ ID NO: 4374 - protein, 3 aa, Artificial Sequence
  synthetic
AAS

SEQ ID NO: 4375 - DNA, 27 bp, Artificial Sequence
  synthetic
caacagagttacagtatccctcccact

SEQ ID NO: 4376 - protein, 9 aa, Artificial Sequence
  synthetic
QQSYSIPPT

SEQ ID NO: 4377 - DNA, 387 bp, Artificial Sequence
  synthetic
gaggtgcagctggtggagtctgggggaggtgtggttcggccgggggggtccctgagactctcctgtgcagcctctggattcacctttggtgattatgacctgaactgggtccgccaagctccagggaaggggctggagtgggtctctggtattaattggaatggcgatatcacaggttatgcagactctgtgaagggccgattcaccatatccagagacatagccaagaaatccctgtatctgcaaatgcacagtctgagagccgaggattcggccttgtatttttgtgcgagggaaggatgtagtagtagcagctgctttccatattactaccagtacttcggtatggacgtctggggccaagggaccacggtcaccgtctcctca

SEQ ID NO: 4378 - protein, 129 aa, Artificial Sequence
  synthetic
EVQLVESGGGVVRPGGSLRLSCAASGFTFGDYDLNWVRQAPGKGLEWVSGINWNGDITGYADSVKGRFTISRDIAKKSLYLQMHSLRAEDSALYFCAREGCSSSSCFPYYYQYFGMDVWGQGTTVTVSS

SEQ ID NO: 4379 - DNA, 24 bp, Artificial Sequence
  synthetic
ggattcacctttggtgattatgac

SEQ ID NO: 4380 - protein, 8 aa, Artificial Sequence
  synthetic
GFTFGDYD

SEQ ID NO: 4381 - DNA, 24 bp, Artificial Sequence
  synthetic
attaattggaatggcgatatcaca

SEQ ID NO: 4382 - protein, 8 aa, Artificial Sequence
  synthetic
INWNGDIT

SEQ ID NO: 4383 - DNA, 66 bp, Artificial Sequence
  synthetic
gcgagggaaggatgtagtagtagcagctgctttccatattactaccagtacttcggtatggacgtc

SEQ ID NO: 4384 - protein, 22 aa, Artificial Sequence
  synthetic
AREGCSSSSCFPYYYQYFGMDV

SEQ ID NO: 4385 - DNA, 339 bp, Artificial Sequence
  synthetic
gacatcgtgatgacccagtctccactctccctgcccgtcacccctggagagccggcctccatctcctgcaggtctagtcagagcctcctgcatagtaatggaaacaactatttggattggtacctgcagaagccagggcagtctccacaactcctgatctttttgaattctaatcgggcctccggggtccctgacaggttcagtggcagtggatcaggcacagattttacactgaaaatcagcagagtggaggctgaggatgttgggatttattactgcatgcaggctctacaaactccgtggacgttcggccaagggaccaaggtggagatcaaacga

SEQ ID NO: 4386 - protein, 113 aa, Artificial Sequence
  synthetic
DIVMTQSPLSLPVTPGEPASISCRSSQSLLHSNGNNYLDWYLQKPGQSPQLLIFLNSNRASGVPDRFSGSGSGTDFTLKISRVEAEDVGIYYCMQALQTPWTFGQGTKVEIKR

SEQ ID NO: 4387 - DNA, 33 bp, Artificial Sequence
  synthetic
cagagcctcctgcatagtaatggaaacaactat

SEQ ID NO: 4388 - protein, 11 aa, Artificial Sequence
  synthetic
QSLLHSNGNNY

SEQ ID NO: 4389 - DNA, 9 bp, Artificial Sequence
  synthetic
ttgaattct

SEQ ID NO: 4390 - protein, 3 aa, Artificial Sequence
  synthetic
LNS

SEQ ID NO: 4391 - DNA, 27 bp, Artificial Sequence
  synthetic
atgcaggctctacaaactccgtggacg

SEQ ID NO: 4392 - protein, 9 aa, Artificial Sequence
  synthetic
MQALQTPWT

SEQ ID NO: 4393 - DNA, 369 bp, Artificial Sequence
  synthetic
caggtgcagctggtggagtcgggcccaggactggtgaagccttcggagaccctgtccctcacctgcactgtctctggtggctccatcagtacttactactggaactggatccgacagcccccagggaagggactggagtggattggacatatcttttatagtgggaccaccagctacaacccctccctcaagagtcgagtcaccatatcagtagacacgtccaggaatcagttctccctgaagctgagctctgtgaccgctgcggacacggccgtctattcctgtgcgagagagaggggcggttttaccgacggtgactacggcgggttcgacccctggggccagggaatcctggtcaccgtctcctca

SEQ ID NO: 4394 - protein, 123 aa, Artificial Sequence
  synthetic
QVQLVESGPGLVKPSETLSLTCTVSGGSISTYYWNWIRQPPGKGLEWIGHIFYSGTTSYNPSLKSRVTISVDTSRNQFSLKLSSVTAADTAVYSCARERGGFTDGDYGGFDPWGQGILVTVSS

SEQ ID NO: 4395 - DNA, 24 bp, Artificial Sequence
  synthetic
ggtggctccatcagtacttactac

SEQ ID NO: 4396 - protein, 8 aa, Artificial Sequence
  synthetic
GGSISTYY

SEQ ID NO: 4397 - DNA, 21 bp, Artificial Sequence
  synthetic
atcttttatagtgggaccacc

SEQ ID NO: 4398 - protein, 7 aa, Artificial Sequence
  synthetic
IFYSGTT

SEQ ID NO: 4399 - DNA, 51 bp, Artificial Sequence
  synthetic
gcgagagagaggggcggttttaccgacggtgactacggcgggttcgacccc

SEQ ID NO: 4400 - protein, 17 aa, Artificial Sequence
  synthetic
ARERGGFTDGDYGGFDP

SEQ ID NO: 4401 - DNA, 324 bp, Artificial Sequence
  synthetic
gacatccagatgacccagtctccatcctccctgtctgcatctataggagacagagtcaccatcacttgccgggcaagtcagagcattagcacctatttaaattggtatcagcagaaaccagggaaagcccctaagctcctgatctatgctgcatccagtttacaaagtggggtcccatcaaggttcagtggcagtggatctgggacagatttcgctctcaccgtcaccagtcttcaacctgaagattttgcaacttactactgtcaacagagttacagtacccctcggacgttcggccaagggaccaaggtggagatcaaacga

SEQ ID NO: 4402 - protein, 108 aa, Artificial Sequence
  synthetic
DIQMTQSPSSLSASIGDRVTITCRASQSISTYLNWYQQKPGKAPKLLIYAASSLQSGVPSRFSGSGSGTDFALTVTSLQPEDFATYYCQQSYSTPRTFGQGTKVEIKR

SEQ ID NO: 4403 - DNA, 18 bp, Artificial Sequence
  synthetic
cagagcattagcacctat

SEQ ID NO: 4404 - protein, 6 aa, Artificial Sequence
  synthetic
QSISTY

SEQ ID NO: 4405 - DNA, 9 bp, Artificial Sequence
  synthetic
gctgcatcc

SEQ ID NO: 4406 - protein, 3 aa, Artificial Sequence
  synthetic
AAS

SEQ ID NO: 4407 - DNA, 27 bp, Artificial Sequence
  synthetic
caacagagttacagtacccctcggacg

SEQ ID NO: 4408 - protein, 9 aa, Artificial Sequence
  synthetic
QQSYSTPRT

SEQ ID NO: 4409 - DNA, 381 bp, Artificial Sequence
  synthetic
caggtgcagctggtggagtctgggggaggtttggtacagcctggcaggtccctgagactctcctgtgcagcctctggattcacctttgatgaatatgacatgcactgggtccggcaagctccagggaagggcctggagtgggtctcaggtattagttggaatagtggtagcataggctatgcggactctgtgaagggccgattcaccatgtccagagacaacgccaagaactccctgtatctggaaatgaacagtctgagacctgaggacacggccttgtattactgtgcaaaacatagagcaataactacggaagagattttctactactactatggtatggacgtctggggccaagggaccacggtcaccgtctcctca

SEQ ID NO: 4410 - protein, 127 aa, Artificial Sequence
  synthetic
QVQLVESGGGLVQPGRSLRLSCAASGFTFDEYDMHWVRQAPGKGLEWVSGISWNSGSIGYADSVKGRFTMSRDNAKNSLYLEMNSLRPEDTALYYCAKHRAITTEEIFYYYYGMDVWGQGTTVTVSS

SEQ ID NO: 4411 - DNA, 24 bp, Artificial Sequence
  synthetic
ggattcacctttgatgaatatgac

SEQ ID NO: 4412 - protein, 8 aa, Artificial Sequence
  synthetic
GFTFDEYD

SEQ ID NO: 4413 - DNA, 24 bp, Artificial Sequence
  synthetic
attagttggaatagtggtagcata

SEQ ID NO: 4414 - protein, 8 aa, Artificial Sequence
  synthetic
ISWNSGSI

SEQ ID NO: 4415 - DNA, 60 bp, Artificial Sequence; identical to SEQ ID NO: 4367
  synthetic

SEQ ID NO: 4416 - protein, 20 aa, Artificial Sequence
  synthetic
AKHRAITTEEIFYYYYGMDV

SEQ ID NO: 4417 - DNA, 324 bp, Artificial Sequence
  synthetic
gacatccagatgacccagtctccatcctccctgtctgcatctgtaggagacagagtcaccttcacttgccgggcaagtcagagcattagcagttatttaaattggtatcagcagaaaccagggaaagcccctaaactcctgatctatgctgcatccagtttgcaaagtggggtcccatcaaggttcagtggcagtggatctgggacagatttcactctcaccatcagcagtctgcagcctgaagattttgcaacttactactgtcaacagagttacagtgtccctcccacttttggccaggggaccaaggtggagatcaaacga

SEQ ID NO: 4418 - protein, 108 aa, Artificial Sequence
  synthetic
DIQMTQSPSSLSASVGDRVTFTCRASQSISSYLNWYQQKPGKAPKLLIYAASSLQSGVPSRFSGSGSGTDFTLTISSLQPEDFATYYCQQSYSVPPTFGQGTKVEIKR

SEQ ID NO: 4419 - DNA, 18 bp, Artificial Sequence
  synthetic
cagagcattagcagttat

SEQ ID NO: 4420 - protein, 6 aa, Artificial Sequence
  synthetic
QSISSY

SEQ ID NO: 4421 - DNA, 9 bp, Artificial Sequence
  synthetic
gctgcatcc

SEQ ID NO: 4422 - protein, 3 aa, Artificial Sequence
  synthetic
AAS

SEQ ID NO: 4423 - DNA, 27 bp, Artificial Sequence
  synthetic
caacagagttacagtgtccctcccact

SEQ ID NO: 4424 - protein, 9 aa, Artificial Sequence
  synthetic
QQSYSVPPT

SEQ ID NO: 4425 - DNA, 384 bp, Artificial Sequence
  synthetic
gaggtgcagctggtggagtcgggcccaggactggtgaagccttcggagaccctgtccctcacctgcactgtctctggtggctccatcagtgcttactactggagctggatccggcagcccccaggaaaggaactggagtggattggttatatttattacagtgggagaaccaactacaacccctccctcaggagtcgagtcaccatatcagtagacacgtccaagaaccagttctccctgaagctgagctctgtgaccgctgcggacacggccgtgtattactgtgcgagagatgaaagggattactatggttcggggacttacgactactactactacggtatggacgtctggggccaagggaccacggtcaccgtctcctca

SEQ ID NO: 4426 - protein, 128 aa, Artificial Sequence
  synthetic
EVQLVESGPGLVKPSETLSLTCTVSGGSISAYYWSWIRQPPGKELEWIGYIYYSGRTNYNPSLRSRVTISVDTSKNQFSLKLSSVTAADTAVYYCARDERDYYGSGTYDYYYYGMDVWGQGTTVTVSS

SEQ ID NO: 4427 - DNA, 24 bp, Artificial Sequence
  synthetic
ggtggctccatcagtgcttactac

SEQ ID NO: 4428 - protein, 8 aa, Artificial Sequence
  synthetic
GGSISAYY

SEQ ID NO: 4429 - DNA, 21 bp, Artificial Sequence
  synthetic
atttattacagtgggagaacc

SEQ ID NO: 4430 - protein, 7 aa, Artificial Sequence
  synthetic
IYYSGRT

SEQ ID NO: 4431 - DNA, 66 bp, Artificial Sequence
  synthetic
gcgagagatgaaagggattactatggttcggggacttacgactactactactacggtatggacgtc

SEQ ID NO: 4432 - protein, 22 aa, Artificial Sequence
  synthetic
ARDERDYYGSGTYDYYYYGMDV

SEQ ID NO: 4433 - DNA, 324 bp, Artificial Sequence
  synthetic
gacatccagatgacccagtctccatcttccgtgtctgcatctgtaggagacagagtcaccatcacttgtcgggcgagtcagggtattaacagctggttagcctggtatcagcagaaaccagggaaagcccctaagctcctgatctatgctgcctccagtttgcaaagtggggtcccatcaagattcagcggcagtggatctgggacagatttcactctcaccatcagcagcctgcagcctgaagattttgcaacttactattgtcaacaggctaaaagtttcccgtacacttttggccaggggaccaaggtggagatcaaacga

SEQ ID NO: 4434 - protein, 108 aa, Artificial Sequence
  synthetic
DIQMTQSPSSVSASVGDRVTITCRASQGINSWLAWYQQKPGKAPKLLIYAASSLQSGVPSRFSGSGSGTDFTLTISSLQPEDFATYYCQQAKSFPYTFGQGTKVEIKR

SEQ ID NO: 4435 - DNA, 18 bp, Artificial Sequence
  synthetic
cagggtattaacagctgg

SEQ ID NO: 4436 - protein, 6 aa, Artificial Sequence
  synthetic
QGINSW

SEQ ID NO: 4437 - DNA, 9 bp, Artificial Sequence
  synthetic
gctgcctcc

SEQ ID NO: 4438 - protein, 3 aa, Artificial Sequence
  synthetic
AAS

SEQ ID NO: 4439 - DNA, 27 bp, Artificial Sequence
  synthetic
caacaggctaaaagtttcccgtacact

SEQ ID NO: 4440 - protein, 9 aa, Artificial Sequence
  synthetic
QQAKSFPYT

SEQ ID NO: 4441 - DNA, 369 bp, Artificial Sequence
  synthetic
gaggtgcagctggtggagtcgggcccaggactggtgaagccttcggagaccctgtccctcacctgcactgtctctggtggctccatcagtacttactactggaactggatccggcagcccccagggaagggactggaatggattgggcatatcttttatagtgggaccaccaactacaacccctccctcaggagtcgagtcaccatatcagtagacacgtccaagaatcagttatccctgaagctgagctctgtgaccgctgcggacacggccttttattcctgtgcgagagagaggggcggggtaaccgacggtgactacggcgggttcgacccctggggccagggaaccctggtcaccgtctcctca

SEQ ID NO: 4442 - protein, 123 aa, Artificial Sequence
  synthetic
EVQLVESGPGLVKPSETLSLTCTVSGGSISTYYWNWIRQPPGKGLEWIGHIFYSGTTNYNPSLRSRVTISVDTSKNQLSLKLSSVTAADTAFYSCARERGGVTDGDYGGFDPWGQGTLVTVSS

SEQ ID NO: 4443 - DNA, 24 bp, Artificial Sequence
  synthetic
ggtggctccatcagtacttactac

SEQ ID NO: 4444 - protein, 8 aa, Artificial Sequence
  synthetic
GGSISTYY

SEQ ID NO: 4445 - DNA, 21 bp, Artificial Sequence
  synthetic
atcttttatagtgggaccacc

SEQ ID NO: 4446 - protein, 7 aa, Artificial Sequence
  synthetic
IFYSGTT

SEQ ID NO: 4447 - DNA, 51 bp, Artificial Sequence; identical to SEQ ID NO: 4287
  synthetic

SEQ ID NO: 4448 - protein, 17 aa, Artificial Sequence
  synthetic
ARERGGVTDGDYGGFDP

SEQ ID NO: 4449 - DNA, 324 bp, Artificial Sequence
  synthetic
gacatcctgatgacccagtctccatcctccctgtctgcatctgtaggagacagagtcagtatcacttgccgggcaagtcagatcattagcacctatttaaattggtatcagcagaaaccaggaaaagcccctcacctcctgatctatgctgcatccaatttgcaaagtggggtcccatcaaggttcagtggcagtggatctgggacagatttcactctcaccatcaccagtctccaacctgaagattttgcaacttactactgtcaacagagttacagtgcccctcggacgttcggccaagggaccaaggtggagatcaaacga

SEQ ID NO: 4450 - protein, 108 aa, Artificial Sequence
  synthetic
DILMTQSPSSLSASVGDRVSITCRASQIISTYLNWYQQKPGKAPHLLIYAASNLQSGVPSRFSGSGSGTDFTLTITSLQPEDFATYYCQQSYSAPRTFGQGTKVEIKR

SEQ ID NO: 4451 - DNA, 18 bp, Artificial Sequence
  synthetic
cagatcattagcacctat

SEQ ID NO: 4452 - protein, 6 aa, Artificial Sequence
  synthetic
QIISTY

SEQ ID NO: 4453 - DNA, 9 bp, Artificial Sequence
  synthetic
gctgcatcc

SEQ ID NO: 4454 - protein, 3 aa, Artificial Sequence
  synthetic
AAS

SEQ ID NO: 4455 - DNA, 27 bp, Artificial Sequence
  synthetic
caacagagttacagtgcccctcggacg

SEQ ID NO: 4456 - protein, 9 aa, Artificial Sequence
  synthetic
QQSYSAPRT

SEQ ID NO: 4457 - DNA, 348 bp, Artificial Sequence
  synthetic
caggtgcagctggtggagtcgggcccaggactggtgaagccttcggagaccctgtccctcacctgcactgtctctggtggctccatcagtgactactattggacctggatccggcagtccccagggaagggactggagtggattggatatatttattacagtggcagcaccaagtacaacccctccctcaagagtcgagtcaccatatcactagacacgtccaagaagcagttctccctgaaactgagttctttgaccgctgcggacacggccgtgtattactgtgtgagagataacggtgacttatttgactactggggccagggaatcctggtcaccgtctcctca

SEQ ID NO: 4458 - protein, 116 aa, Artificial Sequence
  synthetic
QVQLVESGPGLVKPSETLSLTCTVSGGSISDYYWTWIRQSPGKGLEWIGYIYYSGSTKYNPSLKSRVTISLDTSKKQFSLKLSSLTAADTAVYYCVRDNGDLFDYWGQGILVTVSS

SEQ ID NO: 4459 - DNA, 24 bp, Artificial Sequence
  synthetic
ggtggctccatcagtgactactat

SEQ ID NO: 4460 - protein, 8 aa, Artificial Sequence
  synthetic
GGSISDYY

SEQ ID NO: 4461 - DNA, 21 bp, Artificial Sequence
  synthetic
atttattacagtggcagcacc

SEQ ID NO: 4462 - protein, 7 aa, Artificial Sequence
  synthetic
IYYSGST

SEQ ID NO: 4463 - DNA, 30 bp, Artificial Sequence
  synthetic
gtgagagataacggtgacttatttgactac

SEQ ID NO: 4464 - protein, 10 aa, Artificial Sequence
  synthetic
VRDNGDLFDY

SEQ ID NO: 4465 - DNA, 324 bp, Artificial Sequence
  synthetic
gacatccagatgacccagtctccatcctccctgtctgcatctgtaggagacagagtcaccatcacttgccgggcaagtcaaaccattaacacctatttaaattggtatcagcagaaaccagggaaagcccctaaactcctgatctatgtagcatcccgtttgcaaagtggggtcccatcaaggttcagtggcagtggatctgggacagatttcactctcaccatcagcagtctgcaacctggagattttgcaacttactactgtcaacagagttacagtcccccgtacacttttggccaggggaccaaggtggagatcaaacga

SEQ ID NO: 4466 - protein, 108 aa, Artificial Sequence
  synthetic
DIQMTQSPSSLSASVGDRVTITCRASQTINTYLNWYQQKPGKAPKLLIYVASRLQSGVPSRFSGSGSGTDFTLTISSLQPGDFATYYCQQSYSPPYTFGQGTKVEIKR

SEQ ID NO: 4467 - DNA, 18 bp, Artificial Sequence
  synthetic
caaaccattaacacctat

SEQ ID NO: 4468 - protein, 6 aa, Artificial Sequence
  synthetic
QTINTY

SEQ ID NO: 4469 - DNA, 9 bp, Artificial Sequence
  synthetic
gtagcatcc

SEQ ID NO: 4470 - protein, 3 aa, Artificial Sequence
  synthetic
VAS

SEQ ID NO: 4471 - DNA, 27 bp, Artificial Sequence
  synthetic
caacagagttacagtcccccgtacact

SEQ ID NO: 4472 - protein, 9 aa, Artificial Sequence
  synthetic
QQSYSPPYT

SEQ ID NO: 4473 - DNA, 354 bp, Artificial Sequence
  synthetic
caggtgcagctggtggagtcgggcccaggactggtgaagccttcggagaccctgtccctcacctgcactgtctctggtggctccatcagtagttacttctggagctggatccggcagtccccagggaagggactggaatggattggatacatttattatagtgggagcaccaactataatccctccctcgagagtcgaatcaccatatcagtagacacgtccaagaaccagttctccctgaagttgaaatctgtgaccgccgcagacacggccgtgtattattgtgcgagagatgacgcagactataacggtatggacgtctggggccaagggaccacggtcaccgtctcctca

SEQ ID NO: 4474 - protein, 118 aa, Artificial Sequence
  synthetic
QVQLVESGPGLVKPSETLSLTCTVSGGSISSYFWSWIRQSPGKGLEWIGYIYYSGSTNYNPSLESRITISVDTSKNQFSLKLKSVTAADTAVYYCARDDADYNGMDVWGQGTTVTVSS

SEQ ID NO: 4475 - DNA, 24 bp, Artificial Sequence
  synthetic
ggtggctccatcagtagttacttc

SEQ ID NO: 4476 - protein, 8 aa, Artificial Sequence
  synthetic
GGSISSYF

SEQ ID NO: 4477 - DNA, 21 bp, Artificial Sequence
  synthetic
atttattatagtgggagcacc

SEQ ID NO: 4478 - protein, 7 aa, Artificial Sequence
  synthetic
IYYSGST

SEQ ID NO: 4479 - DNA, 36 bp, Artificial Sequence
  synthetic
gcgagagatgacgcagactataacggtatggacgtc

SEQ ID NO: 4480 - protein, 12 aa, Artificial Sequence
  synthetic
ARDDADYNGMDV

SEQ ID NO: 4481 - DNA, 339 bp, Artificial Sequence
  synthetic
gacatcgtgatgacccagtctccagtctccctgtccgtcacccttggacagccggcctccatctcctgcaggtctagtcaaaacctcgtatacagtgatggaaaaacctacttaaattggtttcagcagaggccaggccaatctccaaggcgcctaatttataaggtttctaaacgggactctggagtcccggacagattcagcggcagtgggtcaggcactgatttcacactgaaaatcagcagggttgaggctgaggatgttggagtttattactgcatgcaaagtacagactggccgctcactttcggcggagggaccaaggtggagatcaaacga

SEQ ID NO: 4482 - protein, 113 aa, Artificial Sequence
  synthetic
DIVMTQSPVSLSVTLGQPASISCRSSQNLVYSDGKTYLNWFQQRPGQSPRRLIYKVSKRDSGVPDRFSGSGSGTDFTLKISRVEAEDVGVYYCMQSTDWPLTFGGGTKVEIKR

SEQ ID NO: 4483 - DNA, 33 bp, Artificial Sequence
  synthetic
caaaacctcgtatacagtgatggaaaaacctac

SEQ ID NO: 4484 - protein, 11 aa, Artificial Sequence
  synthetic
QNLVYSDGKTY

SEQ ID NO: 4485 - DNA, 9 bp, Artificial Sequence
  synthetic
aaggtttct

SEQ ID NO: 4486 - protein, 3 aa, Artificial Sequence
  synthetic
KVS

SEQ ID NO: 4487 - DNA, 27 bp, Artificial Sequence
  synthetic
atgcaaagtacagactggccgctcact

SEQ ID NO: 4488 - protein, 9 aa, Artificial Sequence
  synthetic
MQSTDWPLT

SEQ ID NO: 4489 - DNA, 348 bp, Artificial Sequence
  synthetic
gaggtgcagctggtggagtcgggcccaggactggtgaaaccttcggagaccctgtccctcacctgcactgtctctggtggctccatcaataattactactggagctggatccggcagcccccagggaagggactggagtggattgggtatatctattacagtgggaacaccaaatacaacccctccctcaagagtcgagtcaccatatcaatagacacgtccaagaaccagttctccctgaagctgagttctgtgaccgctgcggacacggccgtgtattattgtgtgagagataacggtgacttatttgactattggggccagggaaccctggtcaccgtctcctca

SEQ ID NO: 4490 - protein, 116 aa, Artificial Sequence
  synthetic
EVQLVESGPGLVKPSETLSLTCTVSGGSINNYYWSWIRQPPGKGLEWIGYIYYSGNTKYNPSLKSRVTISIDTSKNQFSLKLSSVTAADTAVYYCVRDNGDLFDYWGQGTLVTVSS

SEQ ID NO: 4491 - DNA, 24 bp, Artificial Sequence
  synthetic
ggtggctccatcaataattactac

SEQ ID NO: 4492 - protein, 8 aa, Artificial Sequence
  synthetic
GGSINNYY

SEQ ID NO: 4493 - DNA, 21 bp, Artificial Sequence
  synthetic
atctattacagtgggaacacc

SEQ ID NO: 4494 - protein, 7 aa, Artificial Sequence
  synthetic
IYYSGNT

SEQ ID NO: 4495 - DNA, 30 bp, Artificial Sequence
  synthetic
gtgagagataacggtgacttatttgactat

SEQ ID NO: 4496 - protein, 10 aa, Artificial Sequence
  synthetic
VRDNGDLFDY

SEQ ID NO: 4497 - DNA, 324 bp, Artificial Sequence
  synthetic
gacatccagatgacccagtctccatcctccctgtctgcatctgtaggagacagagtcaccatcacttgccgggcaagtcagagcattagcaccttttttaattggtatcagcagaaaccagggaaagcccctaagctcctgatctatgttgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaaggtggagatcaaacga

SEQ ID NO: 4498 - protein, 108 aa, Artificial Sequence
  synthetic
DIQMTQSPSSLSASVGDRVTITCRASQSISTFFNWYQQKPGKAPKLLIYVASSLQSGVPSRFSGSGSGTDFTLTISSLQPEDFATYYCQQSYSTPYTFGQGTKVEIKR

SEQ ID NO: 4499 - DNA, 18 bp, Artificial Sequence
  synthetic
cagagcattagcaccttt

SEQ ID NO: 4500 - protein, 6 aa, Artificial Sequence
  synthetic
QSISTF

SEQ ID NO: 4501 - DNA, 9 bp, Artificial Sequence
  synthetic
gttgcatcc

SEQ ID NO: 4502 - protein, 3 aa, Artificial Sequence
  synthetic
VAS

SEQ ID NO: 4503 - DNA, 27 bp, Artificial Sequence
  synthetic
caacagagttacagtaccccgtacact

SEQ ID NO: 4504 - protein, 9 aa, Artificial Sequence
  synthetic
QQSYSTPYT

SEQ ID NO: 4505 - DNA, 354 bp, Artificial Sequence
  synthetic
gaggtgcagctggtggagtcgggcccaggactggtgaagccttcggagaccctgtccctcacctgcactgtctctggtggctccatcagtaattatttttggagttggatccggcagtccccagggaagggactggaatggattggatatatttattatagtgggagcaccaattacaatccctccctcgagagtcgaatcaccatatcagtagacacgtccaagaaccagttctccctgaagctgaaatctgtgaccgccgcagacacggccgtgtattattgtgcgagagatgacgcagactacaacggtatggacgtctggggccaagggaccacggtcaccgtctcctca

SEQ ID NO: 4506 - protein, 118 aa, Artificial Sequence
  synthetic
EVQLVESGPGLVKPSETLSLTCTVSGGSISNYFWSWIRQSPGKGLEWIGYIYYSGSTNYNPSLESRITISVDTSKNQFSLKLKSVTAADTAVYYCARDDADYNGMDVWGQGTTVTVSS

SEQ ID NO: 4507 - DNA, 24 bp, Artificial Sequence
  synthetic
ggtggctccatcagtaattatttt

SEQ ID NO: 4508 - protein, 8 aa, Artificial Sequence
  synthetic
GGSISNYF

SEQ ID NO: 4509 - DNA, 21 bp, Artificial Sequence
  synthetic
atttattatagtgggagcacc

SEQ ID NO: 4510 - protein, 7 aa, Artificial Sequence
  synthetic
IYYSGST

SEQ ID NO: 4511 - DNA, 36 bp, Artificial Sequence
  synthetic
gcgagagatgacgcagactacaacggtatggacgtc

SEQ ID NO: 4512 - protein, 12 aa, Artificial Sequence
  synthetic
ARDDADYNGMDV

SEQ ID NO: 4513 - DNA, 339 bp, Artificial Sequence
  synthetic
gacatcgtgatgacccagtctccactctccctgcccgtcacccttggacagccggcctccatctcctgcaggtctagtcaaagcctcgtatacagtgatggaaaaacctacttaaattggtttcagcagaggccaggccaatctccaaggcgcctaatttataaggtttctaaacgggactctggggtcccggacagattcagcggcagtgggtcaggcactgatttcacactgaaaatcagcagggttgaggctgaggatgttggggtttattactgcatgcaaagtacagactggccgctcactttcggcggagggaccaaggtggagatcaaacga

SEQ ID NO: 4514 - protein, 113 aa, Artificial Sequence
  synthetic
DIVMTQSPLSLPVTLGQPASISCRSSQSLVYSDGKTYLNWFQQRPGQSPRRLIYKVSKRDSGVPDRFSGSGSGTDFTLKISRVEAEDVGVYYCMQSTDWPLTFGGGTKVEIKR

SEQ ID NO: 4515 - DNA, 33 bp, Artificial Sequence
  synthetic
caaagcctcgtatacagtgatggaaaaacctac

SEQ ID NO: 4516 - protein, 11 aa, Artificial Sequence
  synthetic
QSLVYSDGKTY

SEQ ID NO: 4517 - DNA, 9 bp, Artificial Sequence
  synthetic
aaggtttct

SEQ ID NO: 4518 - protein, 3 aa, Artificial Sequence
  synthetic
KVS

SEQ ID NO: 4519 - DNA, 27 bp, Artificial Sequence
  synthetic
atgcaaagtacagactggccgctcact

SEQ ID NO: 4520 - protein, 9 aa, Artificial Sequence
  synthetic
MQSTDWPLT

SEQ ID NO: 4521 - DNA, 369 bp, Artificial Sequence
  synthetic
gaggtgcagctggtggagtctgggggaggcttggtacagcctggcaggtccctgagactctcctgtgcagcctctggattcacctttgatgattttgccatgcactgggtccggcaagctccagggaagggcctggagtgggtctcaggcattagttggaatagtggtaatataggctatgcggactctgtgaagggccgattcaccatctcccgagacaacgccaagaactccctgtatcttcaaatgaacagtctgagagctgcggacacggccttgtatttctgtgcaaaagatatagcagcagctggcctctactactacggtatggacgtctggggccaagggaccacggtcaccgtctcctca

SEQ ID NO: 4522 - protein, 123 aa, Artificial Sequence
  synthetic
EVQLVESGGGLVQPGRSLRLSCAASGFTFDDFAMHWVRQAPGKGLEWVSGISWNSGNIGYADSVKGRFTISRDNAKNSLYLQMNSLRAADTALYFCAKDIAAAGLYYYGMDVWGQGTTVTVSS

SEQ ID NO: 4523 - DNA, 24 bp, Artificial Sequence
  synthetic
ggattcacctttgatgattttgcc

SEQ ID NO: 4524 - protein, 8 aa, Artificial Sequence
  synthetic
GFTFDDFA

SEQ ID NO: 4525 - DNA, 24 bp, Artificial Sequence
  synthetic
attagttggaatagtggtaatata

SEQ ID NO: 4526 - protein, 8 aa, Artificial Sequence
  synthetic
ISWNSGNI

SEQ ID NO: 4527 - DNA, 48 bp, Artificial Sequence
  synthetic
gcaaaagatatagcagcagctggcctctactactacggtatggacgtc

SEQ ID NO: 4528 - protein, 16 aa, Artificial Sequence
  synthetic
AKDIAAAGLYYYGMDV

SEQ ID NO: 4529 - DNA, 324 bp, Artificial Sequence
  synthetic
gacatcgtgatgacccagtctccatccttcctgtctgcatctgtaggagacagagtcaccatcacttgctgggccagtcaggacattaacagttatttagcctggtatcagcaaaaaccagggaaagcccctaaactcctgatctatgatgcatccactttgctaagtggggtcccatcaaggttcagcggcagtggatctgggacagaattcactctcacaatcagcagcctgcagcctgaagattttgcaacttattactgtcaacagcttaatagttacccgttcacttttggccaggggaccaaggtggagatcaaacga

SEQ ID NO: 4530 - protein, 108 aa, Artificial Sequence
  synthetic
DIVMTQSPSFLSASVGDRVTITCWASQDINSYLAWYQQKPGKAPKLLIYDASTLLSGVPSRFSGSGSGTEFTLTISSLQPEDFATYYCQQLNSYPFTFGQGTKVEIKR

SEQ ID NO: 4531 - DNA, 18 bp, Artificial Sequence
  synthetic
caggacattaacagttat

SEQ ID NO: 4532 - protein, 6 aa, Artificial Sequence
  synthetic
QDINSY

SEQ ID NO: 4533 - DNA, 9 bp, Artificial Sequence
  synthetic
gatgcatcc

SEQ ID NO: 4534 - protein, 3 aa, Artificial Sequence
  synthetic
DAS

SEQ ID NO: 4535 - DNA, 27 bp, Artificial Sequence
  synthetic
caacagcttaatagttacccgttcact

SEQ ID NO: 4536 - protein, 9 aa, Artificial Sequence
  synthetic
QQLNSYPFT

SEQ ID NO: 4537 - DNA, 354 bp, Artificial Sequence
  synthetic
gaggtgcagctggtggagtctggagctgaggtgaagaagcctggggcctcagtgaaggtctcctgcaaggcttctggttacacctttaccagctatggtatcagctgggtgcgacaggcccctggacaagggcttgagtggatgggatggatcggcgcttacaaaggtgacacaaattatgcacagaagctccagggcagagtctccatgaccacagacacatccacgagtacaacctacatggagctgaggagccttagatctgacgacacggccgtgtatttctgtgcgagaatagcagtacttgggaactttgactactggggccagggaaccctggtcaccgtctcctca

SEQ ID NO: 4538 - protein, 118 aa, Artificial Sequence
  synthetic
EVQLVESGAEVKKPGASVKVSCKASGYTFTSYGISWVRQAPGQGLEWMGWIGAYKGDTNYAQKLQGRVSMTTDTSTSTTYMELRSLRSDDTAVYFCARIAVLGNFDYWGQGTLVTVSS

SEQ ID NO: 4539 - DNA, 24 bp, Artificial Sequence
  synthetic
ggttacacctttaccagctatggt

SEQ ID NO: 4540 - protein, 8 aa, Artificial Sequence
  synthetic
GYTFTSYG

SEQ ID NO: 4541 - DNA, 24 bp, Artificial Sequence
  synthetic
atcggcgcttacaaaggtgacaca

SEQ ID NO: 4542 - protein, 8 aa, Artificial Sequence
  synthetic
IGAYKGDT

SEQ ID NO: 4543 - DNA, 33 bp, Artificial Sequence
  synthetic
gcgagaatagcagtacttgggaactttgactac

SEQ ID NO: 4544 - protein, 11 aa, Artificial Sequence
  synthetic
ARIAVLGNFDY

SEQ ID NO: 4545 - DNA, 324 bp, Artificial Sequence
  synthetic
gacatcctgatgacccagtctccatcctccctgtctgcatctgtaggagacagagtcaccatcacttgccgggcaagtcagggcattagaaatgatttaggctggtatcagcagaaaccagggaaagcccctaagctcctgatctatgcttcatccagtttacaaagtgatgtcccatcaaggttcagcggcagtggatctggcacagatttcactctcaccatcagcagcctgcagcctgaagattttgcaacttattactgtctacaagattacaattaccctccgacgttcggccaagggaccaaggtggaaatcaaacga

SEQ ID NO: 4546 - protein, 108 aa, Artificial Sequence
  synthetic
DILMTQSPSSLSASVGDRVTITCRASQGIRNDLGWYQQKPGKAPKLLIYASSSLQSDVPSRFSGSGSGTDFTLTISSLQPEDFATYYCLQDYNYPPTFGQGTKVEIKR

SEQ ID NO: 4547 - DNA, 18 bp, Artificial Sequence
  synthetic
cagggcattagaaatgat

SEQ ID NO: 4548 - protein, 6 aa, Artificial Sequence
  synthetic
QGIRND

SEQ ID NO: 4549 - DNA, 9 bp, Artificial Sequence
  synthetic
gcttcatcc

SEQ ID NO: 4550 - protein, 3 aa, Artificial Sequence
  synthetic
ASS

SEQ ID NO: 4551 - DNA, 27 bp, Artificial Sequence
  synthetic
ctacaagattacaattaccctccgacg

SEQ ID NO: 4552 - protein, 9 aa, Artificial Sequence
  synthetic
LQDYNYPPT

SEQ ID NO: 4553 - DNA, 354 bp, Artificial Sequence
  synthetic
gaggtgcagctggtggagtctggacctgaggtgaagaagcctggggcctcagtgaaggtctcctgcaaggcttctggttacgcctttaccagctatggtgtcaactgggtgcgacaggcccctggacaagggcttgagtggatgggatggatcagcgtttacaatggtgacacagattatgcacagaagttccagggcagagtcaccatgaccacagacacatccacgagtacaacctacatggaactgaggagcctgagatctgacgacacggccgtgtatttctgtgcgagaatagctacaactgggaactttgactactggggccagggaaccctggtcaccgtctcctca

SEQ ID NO: 4554 - protein, 118 aa, Artificial Sequence
  synthetic
EVQLVESGPEVKKPGASVKVSCKASGYAFTSYGVNWVRQAPGQGLEWMGWISVYNGDTDYAQKFQGRVTMTTDTSTSTTYMELRSLRSDDTAVYFCARIATTGNFDYWGQGTLVTVSS

SEQ ID NO: 4555 - DNA, 24 bp, Artificial Sequence
  synthetic
ggttacgcctttaccagctatggt

SEQ ID NO: 4556 - protein, 8 aa, Artificial Sequence
  synthetic
GYAFTSYG

SEQ ID NO: 4557 - DNA, 24 bp, Artificial Sequence
  synthetic
atcagcgtttacaatggtgacaca

SEQ ID NO: 4558 - protein, 8 aa, Artificial Sequence
  synthetic
ISVYNGDT

SEQ ID NO: 4559 - DNA, 33 bp, Artificial Sequence
  synthetic
gcgagaatagctacaactgggaactttgactac

SEQ ID NO: 4560 - protein, 11 aa, Artificial Sequence
  synthetic
ARIATTGNFDY

SEQ ID NO: 4561 - DNA, 324 bp, Artificial Sequence
  synthetic
gacatcctgatgacccagtctccatcctccctgtctgcatctgtaggagacagagtcaccatcacttgccgggcaagtcagggcattagaaatgatttaggctggtatcagcagaaaccagggaaagcccctaagctcctgatctatgcttcatccagtttacaaaatggtgtcccatcaaggttcagcggcagtggatctggcacagatttcactctcaccatcagcagcctgcagcctgaagattttgcaacttattactgtctacaagattacaattaccctccgacgttcggccaagggaccaaggtggagatcaaacga

SEQ ID NO: 4562 - protein, 108 aa, Artificial Sequence
  synthetic
DILMTQSPSSLSASVGDRVTITCRASQGIRNDLGWYQQKPGKAPKLLIYASSSLQNGVPSRFSGSGSGTDFTLTISSLQPEDFATYYCLQDYNYPPTFGQGTKVEIKR

SEQ ID NO: 4563 - DNA, 18 bp, Artificial Sequence
  synthetic
cagggcattagaaatgat

SEQ ID NO: 4564 - protein, 6 aa, Artificial Sequence
  synthetic
QGIRND

SEQ ID NO: 4565 - DNA, 9 bp, Artificial Sequence
  synthetic
gcttcatcc

SEQ ID NO: 4566 - protein, 3 aa, Artificial Sequence
  synthetic
ASS

SEQ ID NO: 4567 - DNA, 27 bp, Artificial Sequence
  synthetic
ctacaagattacaattaccctccgacg

SEQ ID NO: 4568 - protein, 9 aa, Artificial Sequence
  synthetic
LQDYNYPPT

SEQ ID NO: 4569 - DNA, 369 bp, Artificial Sequence
  synthetic
gaggtgcagctggtggagtctgggggaggcttggtacagcctggaaggtccctgagactctcctgtgcagcctctggaatcacctttgatgattatggcttccactgggtccggcaagctccagggaagggcctggagtgggtctcaggtattagttggaatagtggtaacataggctatgcggactctgtgaagggccgattcaccatctccagagacaacgccaagaactccctgtatctgcaaatgaacagtctgagagctgacgacacggccttgtattactgcgcaaaagatatagcagcagctggcctctactattacggtatggacgtctggggccaagggaccacggtcaccgtctcctca

SEQ ID NO: 4570 - protein, 123 aa, Artificial Sequence
  synthetic
EVQLVESGGGLVQPGRSLRLSCAASGITFDDYGFHWVRQAPGKGLEWVSGISWNSGNIGYADSVKGRFTISRDNAKNSLYLQMNSLRADDTALYYCAKDIAAAGLYYYGMDVWGQGTTVTVSS

SEQ ID NO: 4571 - DNA, 24 bp, Artificial Sequence
  synthetic
ggaatcacctttgatgattatggc

SEQ ID NO: 4572 - protein, 8 aa, Artificial Sequence
  synthetic
GITFDDYG

SEQ ID NO: 4573 - DNA, 24 bp, Artificial Sequence
  synthetic
attagttggaatagtggtaacata

SEQ ID NO: 4574 - protein, 8 aa, Artificial Sequence
  synthetic
ISWNSGNI

SEQ ID NO: 4575 - DNA, 48 bp, Artificial Sequence
  synthetic
gcaaaagatatagcagcagctggcctctactattacggtatggacgtc

SEQ ID NO: 4576 - protein, 16 aa, Artificial Sequence
  synthetic
AKDIAAAGLYYYGMDV

SEQ ID NO: 4577 - DNA, 324 bp, Artificial Sequence
  synthetic
gacatccagatgacccagtcaccatccttcctgtctgcatctgtaggagacagagtcaccatcacttgctgggccagtcaggacattactacttatttagtctggtatcagcaaaaaccagggaaagcccctaagttcctgatctatgctgcatccactttgcaaagaggggtcccatcaaggttcagcggcagtggatctgggacagaattcactctcacaatcagcagcctgcagcctgcagattttgcaacttattactgtcaacagcttaatagttatccgttcacttttggccaggggaccaaggtggagatcaaacga

SEQ ID NO: 4578 - protein, 108 aa, Artificial Sequence
  synthetic
DIQMTQSPSFLSASVGDRVTITCWASQDITTYLVWYQQKPGKAPKFLIYAASTLQRGVPSRFSGSGSGTEFTLTISSLQPADFATYYCQQLNSYPFTFGQGTKVEIKR

SEQ ID NO: 4579 - DNA, 18 bp, Artificial Sequence
  synthetic
caggacattactacttat

SEQ ID NO: 4580 - protein, 6 aa, Artificial Sequence
  synthetic
QDITTY

SEQ ID NO: 4581 - DNA, 9 bp, Artificial Sequence
  synthetic
gctgcatcc

SEQ ID NO: 4582 - protein, 3 aa, Artificial Sequence
  synthetic
AAS

SEQ ID NO: 4583 - DNA, 27 bp, Artificial Sequence
  synthetic
caacagcttaatagttatccgttcact

SEQ ID NO: 4584 - protein, 9 aa, Artificial Sequence
  synthetic
QQLNSYPFT

SEQ ID NO: 4585 - DNA, 369 bp, Artificial Sequence
  synthetic
gaggtgcagctggtggagtctgggggaggcttggtacagcctggcaggtccctgagactctcctgtgcagcctctggattcacctttgatgattttgccatgcactgggtccggcaaggtccagggaagggcctggagtgggtctcaggcattagttggaatagtggtaatataggctatgcggactctgtgaagggccgattcaccgtctccagagacaacgccaagagctccctgtatcttcaaatgaacagtctgagagctgcggacacggccttgtatttctgtgcaaaagatatagcagcagctggcctctactactacggtatggacgtctggggccaagggaccacggtcaccgtctcctca

SEQ ID NO: 4586 - protein, 123 aa, Artificial Sequence
  synthetic
EVQLVESGGGLVQPGRSLRLSCAASGFTFDDFAMHWVRQGPGKGLEWVSGISWNSGNIGYADSVKGRFTVSRDNAKSSLYLQMNSLRAADTALYFCAKDIAAAGLYYYGMDVWGQGTTVTVSS

SEQ ID NO: 4587 - DNA, 24 bp, Artificial Sequence
  synthetic
ggattcacctttgatgattttgcc

SEQ ID NO: 4588 - protein, 8 aa, Artificial Sequence
  synthetic
GFTFDDFA

SEQ ID NO: 4589 - DNA, 24 bp, Artificial Sequence
  synthetic
attagttggaatagtggtaatata

SEQ ID NO: 4590 - protein, 8 aa, Artificial Sequence
  synthetic
ISWNSGNI

SEQ ID NO: 4591 - DNA, 48 bp, Artificial Sequence; identical to SEQ ID NO: 4527
  synthetic

SEQ ID NO: 4592 - protein, 16 aa, Artificial Sequence
  synthetic
AKDIAAAGLYYYGMDV

SEQ ID NO: 4593 - DNA, 324 bp, Artificial Sequence
  synthetic
gacatccagatgacccagtctccatccttcctgtctgcatctgtaggagacagagtcaccatcacttgctgggccagtcaggacattaacagttatttagtctggtatcagcaaaaaccagggaaagcccctaaactcctgatctatgatgcatccactttgctgagtggggtcccatcaaggttcagcggcagtggatctgggacagagttcactctcacaatcagcagcctgcagcctgaagattttgcaacttattactgtcaacagcttaatagttacccgttcacttttggccaggggaccaaggtggagatcaaacga

SEQ ID NO: 4594 - protein, 108 aa, Artificial Sequence
  synthetic
DIQMTQSPSFLSASVGDRVTITCWASQDINSYLVWYQQKPGKAPKLLIYDASTLLSGVPSRFSGSGSGTEFTLTISSLQPEDFATYYCQQLNSYPFTFGQGTKVEIKR

SEQ ID NO: 4595 - DNA, 18 bp, Artificial Sequence
  synthetic
caggacattaacagttat

SEQ ID NO: 4596 - protein, 6 aa, Artificial Sequence
  synthetic
QDINSY

SEQ ID NO: 4597 - DNA, 9 bp, Artificial Sequence
  synthetic
gatgcatcc

SEQ ID NO: 4598 - protein, 3 aa, Artificial Sequence
  synthetic
DAS

SEQ ID NO: 4599 - DNA, 27 bp, Artificial Sequence
  synthetic
caacagcttaatagttacccgttcact

SEQ ID NO: 4600 - protein, 9 aa, Artificial Sequence
  synthetic
QQLNSYPFT

SEQ ID NO: 4601 - DNA, 354 bp, Artificial Sequence
  synthetic
gaggtgcagctggtggagtcgggcccaggactggtgaagccttcggagaccctgtccctcacctgcactgtctctggtggctccatcagtagttacttctggagctggatccggcagtccccagggaagggactggaatggattggatatatttattatagtgggagcaccaattacaatccctccctcgagagtcgaatcaccatatcagtagacacgtccaagaaccagttctccctgaagctgaaatctgtgaccgccgcagacacggccgtgtattattgtgcgagagatgacgcagactacaacggtatggacgtctggggccaagggaccacggtcaccgtctcctca

SEQ ID NO: 4602 - protein, 118 aa, Artificial Sequence
  synthetic
EVQLVESGPGLVKPSETLSLTCTVSGGSISSYFWSWIRQSPGKGLEWIGYIYYSGSTNYNPSLESRITISVDTSKNQFSLKLKSVTAADTAVYYCARDDADYNGMDVWGQGTTVTVSS

SEQ ID NO: 4603 - DNA, 24 bp, Artificial Sequence
  synthetic
ggtggctccatcagtagttacttc

SEQ ID NO: 4604 - protein, 8 aa, Artificial Sequence
  synthetic
GGSISSYF

SEQ ID NO: 4605 - DNA, 21 bp, Artificial Sequence
  synthetic
atttattatagtgggagcacc

SEQ ID NO: 4606 - protein, 7 aa, Artificial Sequence
  synthetic
IYYSGST

SEQ ID NO: 4607 - DNA, 36 bp, Artificial Sequence; identical to SEQ ID NO: 4511
  synthetic

SEQ ID NO: 4608 - protein, 12 aa, Artificial Sequence
  synthetic
ARDDADYNGMDV

SEQ ID NO: 4609 - DNA, 324 bp, Artificial Sequence; identical to SEQ ID NO: 337
  synthetic

SEQ ID NO: 4610 - protein, 108 aa, Artificial Sequence; identical to SEQ ID NO: 338
  synthetic

SEQ ID NO: 4611 - DNA, 18 bp, Artificial Sequence
  synthetic
cagagcattagcagctat

SEQ ID NO: 4612 - protein, 6 aa, Artificial Sequence
  synthetic
QSISSY

SEQ ID NO: 4613 - DNA, 9 bp, Artificial Sequence
  synthetic
gctgcatcc

SEQ ID NO: 4614 - protein, 3 aa, Artificial Sequence
  synthetic
AAS

SEQ ID NO: 4615 - DNA, 27 bp, Artificial Sequence
  synthetic
caacagagttacagtacccctctcact

SEQ ID NO: 4616 - protein, 9 aa, Artificial Sequence
  synthetic
QQSYSTPLT

SEQ ID NO: 4617 - DNA, 348 bp, Artificial Sequence
  synthetic
gaggtgcagctggtggagtcgggcccaggactggtgaagccttcggagaccctgtccctcacctgcactgtctctggtggctccattagtggtttctactggagctggatccggcagcccccagggaagggactggagtggattgggtatatctattacagtgggagcactaagtacaacccctccctcaagagtcgagtcaccttgtcagtagacacgtccaagaaccagttctccctgaagctgagctctgtgaccgctgcggacacggccgtgtattactgtgtgagagataacggtgacttatttgactattggggccagggaaccacggtcaccgtctcctca

SEQ ID NO: 4618 - protein, 116 aa, Artificial Sequence
  synthetic
EVQLVESGPGLVKPSETLSLTCTVSGGSISGFYWSWIRQPPGKGLEWIGYIYYSGSTKYNPSLKSRVTLSVDTSKNQFSLKLSSVTAADTAVYYCVRDNGDLFDYWGQGTTVTVSS

SEQ ID NO: 4619 - DNA, 24 bp, Artificial Sequence
  synthetic
ggtggctccattagtggtttctac

SEQ ID NO: 4620 - protein, 8 aa, Artificial Sequence
  synthetic
GGSISGFY

SEQ ID NO: 4621 - DNA, 21 bp, Artificial Sequence
  synthetic
atctattacagtgggagcact

SEQ ID NO: 4622 - protein, 7 aa, Artificial Sequence
  synthetic
IYYSGST

SEQ ID NO: 4623 - DNA, 30 bp, Artificial Sequence; identical to SEQ ID NO: 4495
  synthetic

SEQ ID NO: 4624 - protein, 10 aa, Artificial Sequence
  synthetic
VRDNGDLFDY

SEQ ID NO: 4625 - DNA, 324 bp, Artificial Sequence
  synthetic
gacatcctgatgacccagtctccatcctccctgtctgcatctgtaggagacagagtcaccatcacttgccgggcaagtcagagcattagcagctatttaaactggtatcagcagaaaccagggaaagcccctaaactcctgatctatgttgcatccagtttgcgaagtggggtcccatcaaggttcagtggcagtgggtctgggacagatttcactctcaccatcagcagtctgcaacctgaagattttgcaacttactgctgtcaacagagttacagtaccccgtacacttttggccaggggaccaaggtggagatcaaacga

SEQ ID NO: 4626 - protein, 108 aa, Artificial Sequence
  synthetic
DILMTQSPSSLSASVGDRVTITCRASQSISSYLNWYQQKPGKAPKLLIYVASSLRSGVPSRFSGSGSGTDFTLTISSLQPEDFATYCCQQSYSTPYTFGQGTKVEIKR

SEQ ID NO: 4627 - DNA, 18 bp, Artificial Sequence
  synthetic
cagagcattagcagctat

SEQ ID NO: 4628 - protein, 6 aa, Artificial Sequence
  synthetic
QSISSY

SEQ ID NO: 4629 - DNA, 9 bp, Artificial Sequence
  synthetic
gttgcatcc

SEQ ID NO: 4630 - protein, 3 aa, Artificial Sequence
  synthetic
VAS

SEQ ID NO: 4631 - DNA, 27 bp, Artificial Sequence
  synthetic
caacagagttacagtaccccgtacact

SEQ ID NO: 4632 - protein, 9 aa, Artificial Sequence
  synthetic
QQSYSTPYT

SEQ ID NO: 4633 - DNA, 369 bp, Artificial Sequence
  synthetic
gaggtgcagctggtggagtctgggggaggcttggtacagcctggcaggtccctgagactctcctgtgcagcctctggattcacgtttgatgattatgccatgcactgggtccggcaagttccagggaagggcctggagtgggtctcagggattagttggaatagtggtaacataggctatgcggactctgtgaagggccgattcaccatctccagagacaacgacaagaattccctgtatcttcaaatgaacagtctgagaactgaggacacggccttgtattactgtgcaaaagatatagcagcagctggcctctactactacggtatggacgtctggggccaagggaccacggtcaccgtctcctca

SEQ ID NO: 4634 - protein, 123 aa, Artificial Sequence
  synthetic
EVQLVESGGGLVQPGRSLRLSCAASGFTFDDYAMHWVRQVPGKGLEWVSGISWNSGNIGYADSVKGRFTISRDNDKNSLYLQMNSLRTEDTALYYCAKDIAAAGLYYYGMDVWGQGTTVTVSS

SEQ ID NO: 4635 - DNA, 24 bp, Artificial Sequence
  synthetic
ggattcacgtttgatgattatgcc

SEQ ID NO: 4636 - protein, 8 aa, Artificial Sequence
  synthetic
GFTFDDYA

SEQ ID NO: 4637 - DNA, 24 bp, Artificial Sequence
  synthetic
attagttggaatagtggtaacata

SEQ ID NO: 4638 - protein, 8 aa, Artificial Sequence
  synthetic
ISWNSGNI

SEQ ID NO: 4639 - DNA, 48 bp, Artificial Sequence; identical to SEQ ID NO: 4527
  synthetic

SEQ ID NO: 4640 - protein, 16 aa, Artificial Sequence
  synthetic
AKDIAAAGLYYYGMDV

SEQ ID NO: 4641 - DNA, 324 bp, Artificial Sequence
  synthetic
gacatccagatgacccagtctccatccttcctgtctgcatctgtaggagacagagtcaccatcacttgctgggccagtcaggacattaacaattatttagtctggtatcagcaaaaaccagggaaaggccctaagctcctgatctatgctgcatccactttattaagtggggtcccatcaaggttcagcggcagtggatctgggacagaattcactctcacaatcagcagcctgcagcctgaagattttgcaacttattactgtcaacaagttaacagttacccgttcactcttggccaggggaccaaggtggagatcaaacga

SEQ ID NO: 4642 - protein, 108 aa, Artificial Sequence
  synthetic
DIQMTQSPSFLSASVGDRVTITCWASQDINNYLVWYQQKPGKGPKLLIYAASTLLSGVPSRFSGSGSGTEFTLTISSLQPEDFATYYCQQVNSYPFTLGQGTKVEIKR

SEQ ID NO: 4643 - DNA, 18 bp, Artificial Sequence
  synthetic
caggacattaacaattat

SEQ ID NO: 4644 - protein, 6 aa, Artificial Sequence
  synthetic
QDINNY

SEQ ID NO: 4645 - DNA, 9 bp, Artificial Sequence
  synthetic
gctgcatcc

SEQ ID NO: 4646 - protein, 3 aa, Artificial Sequence
  synthetic
AAS

SEQ ID NO: 4647 - DNA, 27 bp, Artificial Sequence
  synthetic
caacaagttaacagttacccgttcact

SEQ ID NO: 4648 - protein, 9 aa, Artificial Sequence
  synthetic
QQVNSYPFT

SEQ ID NO: 4649 - DNA, 369 bp, Artificial Sequence
  synthetic
caggtgcagctggtggagtctgggggaggcttggtacagcctggcaggtccctgagactctcctgtgcagcctctggattcacctttgatgattttgccatgcactgggtccggcaagctccagggaagggcctggagtgggtctcaggcattagttggaatagcggtaatataggctatgcggactctgtgaagggccgattcaccgtctccagagacaacgccaagagctccctgtatcttcaaatgaacagtctgagagctgcggacacggccttgtatttctgtgcaaaagatatagcagcagctggcctctactactacggtatggacgtctggggccaagggaccacggtcaccgtctcctca

SEQ ID NO: 4650 - protein, 123 aa, Artificial Sequence
  synthetic
QVQLVESGGGLVQPGRSLRLSCAASGFTFDDFAMHWVRQAPGKGLEWVSGISWNSGNIGYADSVKGRFTVSRDNAKSSLYLQMNSLRAADTALYFCAKDIAAAGLYYYGMDVWGQGTTVTVSS

SEQ ID NO: 4651 - DNA, 24 bp, Artificial Sequence
  synthetic
ggattcacctttgatgattttgcc

SEQ ID NO: 4652 - protein, 8 aa, Artificial Sequence
  synthetic
GFTFDDFA

SEQ ID NO: 4653 - DNA, 24 bp, Artificial Sequence
  synthetic
attagttggaatagcggtaatata

SEQ ID NO: 4654 - protein, 8 aa, Artificial Sequence
  synthetic
ISWNSGNI

SEQ ID NO: 4655 - DNA, 48 bp, Artificial Sequence; identical to SEQ ID NO: 4527
  synthetic

SEQ ID NO: 4656 - protein, 16 aa, Artificial Sequence
  synthetic
AKDIAAAGLYYYGMDV

SEQ ID NO: 4657 - DNA, 324 bp, Artificial Sequence
  synthetic
gacatcctgatgacccagtctccatccttcctgtctgcatctgtaggagacagagtcaccatcacttgctgggccagtcaggacattaacagttatttagtctggtatcagcaaaaaccagggaaagcccctaaactcctgatctatgatgcatccactttgctgagtggggtcccatcaaggttcagcggcagtggatctgggacagaattcactctcacaatcagcagcctgcagcctgaagattttgcaacttattactgtcaacagcttaatagttacccgttcacttttggccaggggaccaaggtggagatcaaacga

SEQ ID NO: 4658 - protein, 108 aa, Artificial Sequence
  synthetic
DILMTQSPSFLSASVGDRVTITCWASQDINSYLVWYQQKPGKAPKLLIYDASTLLSGVPSRFSGSGSGTEFTLTISSLQPEDFATYYCQQLNSYPFTFGQGTKVEIKR

SEQ ID NO: 4659 - DNA, 18 bp, Artificial Sequence
  synthetic
caggacattaacagttat

SEQ ID NO: 4660 - protein, 6 aa, Artificial Sequence
  synthetic
QDINSY

SEQ ID NO: 4661 - DNA, 9 bp, Artificial Sequence
  synthetic
gatgcatcc

SEQ ID NO: 4662 - protein, 3 aa, Artificial Sequence
  synthetic
DAS

SEQ ID NO: 4663 - DNA, 27 bp, Artificial Sequence
  synthetic
caacagcttaatagttacccgttcact

SEQ ID NO: 4664 - protein, 9 aa, Artificial Sequence
  synthetic
QQLNSYPFT

SEQ ID NO: 4665 - DNA, 357 bp, Artificial Sequence
  synthetic
gaggtgcagctggtggagtctgggggaggcttggtacagcctggggggtccctgagactctcctgtgcagcctctggattcacctttagcagctatgccatgagctgggtccgccaggctccagggaagggcctggagtgggtctcaactattagtggtggtggtggtaccacatactacgcagactccgtgaagggccggttcaccatctccagagacaattccaagaacacgctgtatctgcaaatgaacagcctgagagccgaggacacggccgtatattattgtgcggctggggatcgtcttgactggtacttcgatttttggggccgtggcaccctggtcaccgtctcctca

SEQ ID NO: 4666 - protein, 119 aa, Artificial Sequence
  synthetic
EVQLVESGGGLVQPGGSLRLSCAASGFTFSSYAMSWVRQAPGKGLEWVSTISGGGGTTYYADSVKGRFTISRDNSKNTLYLQMNSLRAEDTAVYYCAAGDRLDWYFDFWGRGTLVTVSS

SEQ ID NO: 4667 - DNA, 24 bp, Artificial Sequence
  synthetic
ggattcacctttagcagctatgcc

SEQ ID NO: 4668 - protein, 8 aa, Artificial Sequence
  synthetic
GFTFSSYA

SEQ ID NO: 4669 - DNA, 24 bp, Artificial Sequence
  synthetic
attagtggtggtggtggtaccaca

SEQ ID NO: 4670 - protein, 8 aa, Artificial Sequence
  synthetic
ISGGGGTT

SEQ ID NO: 4671 - DNA, 36 bp, Artificial Sequence
  synthetic
gcggctggggatcgtcttgactggtacttcgatttt

SEQ ID NO: 4672 - protein, 12 aa, Artificial Sequence
  synthetic
AAGDRLDWYFDF

SEQ ID NO: 4673 - DNA, 324 bp, Artificial Sequence
  synthetic
gacatcctgatgacccagtctccatcctccctgtctgcatctgtaggagacagagtcaccatcaattgccgggcaagtcagagcattttcacctctttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagttccccattcactttcggccctgggaccaaggtggagatcaaacga

SEQ ID NO: 4674 - protein, 108 aa, Artificial Sequence
  synthetic
DILMTQSPSSLSASVGDRVTINCRASQSIFTSLNWYQQRPGKAPKLLIYAASSLQSGVPSRFSGSGSGTDFTLTISSLQPEDFATYYCQQSYSSPFTFGPGTKVEIKR

SEQ ID NO: 4675 - DNA, 18 bp, Artificial Sequence
  synthetic
cagagcattttcacctct

SEQ ID NO: 4676 - protein, 6 aa, Artificial Sequence
  synthetic
QSIFTS

SEQ ID NO: 4677 - DNA, 9 bp, Artificial Sequence
  synthetic
gctgcatcc

SEQ ID NO: 4678 - protein, 3 aa, Artificial Sequence
  synthetic
AAS

SEQ ID NO: 4679 - DNA, 27 bp, Artificial Sequence
  synthetic
caacagagttacagttccccattcact

SEQ ID NO: 4680 - protein, 9 aa, Artificial Sequence
  synthetic
QQSYSSPFT

SEQ ID NO: 4681 - DNA, 369 bp, Artificial Sequence
  synthetic
gaggtgcagctggtggagtctgggggaggcttggtacagcctggcaggtccctgagactctcctgtgcagcctctggattcacctttgatgattttgccatgcactgggtccggcaagctccagggaagggcctggagtgggtctcaggcattagttggaatagtggtaatataggctatgcggactctgtgaagggccgattcaccgtctccagagacaacgccaagagctccctgtatcttcaaatgaacagtctgagagctgcggacacggccttgtatttctgtgcaaaagatatagcagctgctggcctctactactacggtatggacgtctggggtcaagggaccacggtcaccgtctcctca

SEQ ID NO: 4682 - protein, 123 aa, Artificial Sequence
  synthetic
EVQLVESGGGLVQPGRSLRLSCAASGFTFDDFAMHWVRQAPGKGLEWVSGISWNSGNIGYADSVKGRFTVSRDNAKSSLYLQMNSLRAADTALYFCAKDIAAAGLYYYGMDVWGQGTTVTVSS

SEQ ID NO: 4683 - DNA, 24 bp, Artificial Sequence
  synthetic
ggattcacctttgatgattttgcc

SEQ ID NO: 4684 - protein, 8 aa, Artificial Sequence
  synthetic
GFTFDDFA

SEQ ID NO: 4685 - DNA, 24 bp, Artificial Sequence
  synthetic
attagttggaatagtggtaatata

SEQ ID NO: 4686 - protein, 8 aa, Artificial Sequence
  synthetic
ISWNSGNI

SEQ ID NO: 4687 - DNA, 48 bp, Artificial Sequence
  synthetic
gcaaaagatatagcagctgctggcctctactactacggtatggacgtc

SEQ ID NO: 4688 - protein, 16 aa, Artificial Sequence
  synthetic
AKDIAAAGLYYYGMDV

SEQ ID NO: 4689 - DNA, 324 bp, Artificial Sequence
  synthetic
gacatccagatgacccagtctccatccttcctgtctgcatctgtaggagacagagtcaccatcacttgctgggccagtcaggacattaacagttatttagtctggtatcagcaaaaaccagggaaagcccctaaactcctgatctatgatgcatccactttgctgagtggggtcccatcagggttcagcggcagtggatctgggacagaattcactctcacaatcagcagcctgcagcctgaagattttgcaacttattactgtcaacagcttaatagttacccgttcacttttggccaggggaccaaggtggagatcaaacga

SEQ ID NO: 4690 - protein, 108 aa, Artificial Sequence
  synthetic
DIQMTQSPSFLSASVGDRVTITCWASQDINSYLVWYQQKPGKAPKLLIYDASTLLSGVPSGFSGSGSGTEFTLTISSLQPEDFATYYCQQLNSYPFTFGQGTKVEIKR

SEQ ID NO: 4691 - DNA, 18 bp, Artificial Sequence
  synthetic
caggacattaacagttat

SEQ ID NO: 4692 - protein, 6 aa, Artificial Sequence
  synthetic
QDINSY

SEQ ID NO: 4693 - DNA, 9 bp, Artificial Sequence
  synthetic
gatgcatcc

SEQ ID NO: 4694 - protein, 3 aa, Artificial Sequence
  synthetic
DAS

SEQ ID NO: 4695 - DNA, 27 bp, Artificial Sequence
  synthetic
caacagcttaatagttacccgttcact

SEQ ID NO: 4696 - protein, 9 aa, Artificial Sequence
  synthetic
QQLNSYPFT

SEQ ID NO: 4697 - DNA, 354 bp, Artificial Sequence
  synthetic
gaggtgcagctggtggagtctggagctgaggtgaagaagcctggggcctcagtgaaggtctcctgcaaggcttctggttacacctttagcagctatggtatcacctggatgcgacaggcccctggacaagggcttgagtggatgggatggatcagcgcttacaatggagacacagactatgcacagcagttccagggcagagtcaccatgaccacagacacatccacgaacacagtctacatggaactgaggagcctgagatctgacgacacggccgtgttttactgtgcgagaatagcagtacctgggaactttgactactggggccagggaaccctggtcaccgtctcctca

SEQ ID NO: 4698 - protein, 118 aa, Artificial Sequence
  synthetic
EVQLVESGAEVKKPGASVKVSCKASGYTFSSYGITWMRQAPGQGLEWMGWISAYNGDTDYAQQFQGRVTMTTDTSTNTVYMELRSLRSDDTAVFYCARIAVPGNFDYWGQGTLVTVSS

SEQ ID NO: 4699 - DNA, 24 bp, Artificial Sequence
  synthetic
ggttacacctttagcagctatggt

SEQ ID NO: 4700 - protein, 8 aa, Artificial Sequence
  synthetic
GYTFSSYG

SEQ ID NO: 4701 - DNA, 24 bp, Artificial Sequence
  synthetic
atcagcgcttacaatggagacaca

SEQ ID NO: 4702 - protein, 8 aa, Artificial Sequence
  synthetic
ISAYNGDT

SEQ ID NO: 4703 - DNA, 33 bp, Artificial Sequence
  synthetic
gcgagaatagcagtacctgggaactttgactac

SEQ ID NO: 4704 - protein, 11 aa, Artificial Sequence
  synthetic
ARIAVPGNFDY

SEQ ID NO: 4705 - DNA, 324 bp, Artificial Sequence
  synthetic
gacatcctgatgacccagtctccatcctccctgtctgcatctataggagacagagtcaccatcacttgccgggcaagtcagggcattagaagtgatttaggctggtatcagcagaaaccagggaaagcccctaaactcctgatctatggtgcatccagtttacaaagtggggtcccatcaaggttcagcggcagtggatctggcacagatttcactctcaccatcagcagcctgcagcctgaagattgtgcaacttattattgtctacaagactacaacaaccctccgacgttcggccaagggaccaaggtggagatcaaacga

SEQ ID NO: 4706 - protein, 108 aa, Artificial Sequence
  synthetic
DILMTQSPSSLSASIGDRVTITCRASQGIRSDLGWYQQKPGKAPKLLIYGASSLQSGVPSRFSGSGSGTDFTLTISSLQPEDCATYYCLQDYNNPPTFGQGTKVEIKR

SEQ ID NO: 4707 - DNA, 18 bp, Artificial Sequence
  synthetic
cagggcattagaagtgat

SEQ ID NO: 4708 - protein, 6 aa, Artificial Sequence
  synthetic
QGIRSD

SEQ ID NO: 4709 - DNA, 9 bp, Artificial Sequence
  synthetic
ggtgcatcc

SEQ ID NO: 4710 - protein, 3 aa, Artificial Sequence
  synthetic
GAS

SEQ ID NO: 4711 - DNA, 27 bp, Artificial Sequence
  synthetic
ctacaagactacaacaaccctccgacg

SEQ ID NO: 4712 - protein, 9 aa, Artificial Sequence
  synthetic
LQDYNNPPT

SEQ ID NO: 4713 - DNA, 369 bp, Artificial Sequence
  synthetic
gaggtgcagctggtggagtctgggggaggcttggtacagcctggcaggtccctgagactctcctgtgcagcctctggattcacctttgatgattttgccatgcactgggtccggcaagctccagggaagggcctggagtgggtctcaggcattagttggaatagtggtaatataggctatgcggactctgtgaagggccgattcaccatctccagagacaacgccaagaggtccctgtatcttcaaatgaacagtctgagagctgcggacacggccttgtatttctgtgcaaaagatatagcagcagctggcctctactactacggtatggacgtctggggccaagggaccacggtcaccgtctcctca

SEQ ID NO: 4714 - protein, 123 aa, Artificial Sequence
  synthetic
EVQLVESGGGLVQPGRSLRLSCAASGFTFDDFAMHWVRQAPGKGLEWVSGISWNSGNIGYADSVKGRFTISRDNAKRSLYLQMNSLRAADTALYFCAKDIAAAGLYYYGMDVWGQGTTVTVSS

SEQ ID NO: 4715 - DNA, 24 bp, Artificial Sequence
  synthetic
ggattcacctttgatgattttgcc

SEQ ID NO: 4716 - protein, 8 aa, Artificial Sequence
  synthetic
GFTFDDFA

SEQ ID NO: 4717 - DNA, 24 bp, Artificial Sequence
  synthetic
attagttggaatagtggtaatata

SEQ ID NO: 4718 - protein, 8 aa, Artificial Sequence
  synthetic
ISWNSGNI

SEQ ID NO: 4719 - DNA, 48 bp, Artificial Sequence; identical to SEQ ID NO: 4527
  synthetic

SEQ ID NO: 4720 - protein, 16 aa, Artificial Sequence
  synthetic
AKDIAAAGLYYYGMDV

SEQ ID NO: 4721 - DNA, 324 bp, Artificial Sequence
  synthetic
gacatcctgatgacccagtctccatccttcctgtctgcatctgtaggagacagagtcaccatcacttgctgggccagtcaggacattaacagttatttagcctggtatcagcaaaaaccagggaaagcccctaaactcctgatctatgatgcatccactttgctaagtggggtcccatcaaggttcagcggcagtggatctgggacagaattcactctcacaatcagcagcctgcagcctgaagattttgcaacttattactgtcaacagcttaatagttacccgttcacttttggccaggggaccaaggtggagatcaaacga

SEQ ID NO: 4722 - protein, 108 aa, Artificial Sequence
  synthetic
DILMTQSPSFLSASVGDRVTITCWASQDINSYLAWYQQKPGKAPKLLIYDASTLLSGVPSRFSGSGSGTEFTLTISSLQPEDFATYYCQQLNSYPFTFGQGTKVEIKR

SEQ ID NO: 4723 - DNA, 18 bp, Artificial Sequence
  synthetic
caggacattaacagttat

SEQ ID NO: 4724 - protein, 6 aa, Artificial Sequence
  synthetic
QDINSY

SEQ ID NO: 4725 - DNA, 9 bp, Artificial Sequence
  synthetic
gatgcatcc

SEQ ID NO: 4726 - protein, 3 aa, Artificial Sequence
  synthetic
DAS

SEQ ID NO: 4727 - DNA, 27 bp, Artificial Sequence
  synthetic
caacagcttaatagttacccgttcact

SEQ ID NO: 4728 - protein, 9 aa, Artificial Sequence
  synthetic
QQLNSYPFT

SEQ ID NO: 4729 - DNA, 354 bp, Artificial Sequence
  synthetic
gaggtgcagctggtggagtcgggcccaggactggtgaagccttcggagaccctgtccctcacctgcactgtctctggtggctccatcagtggttccttctggagctggatccggcagtccccagggaagggactggaatggattggatatatttattatactgggagtaccaattacaatccctccctcgagagtcgaatcaccatatcagtagacacgtccaagaaccagttctccctgaagctgaaatctgtgaccgccgcagacacggccgtgtattattgtgcgagagatgacgcagactacaacggtatggacgtctggggccaagggaccacggtcaccgtctcctca

SEQ ID NO: 4730 - protein, 118 aa, Artificial Sequence
  synthetic
EVQLVESGPGLVKPSETLSLTCTVSGGSISGSFWSWIRQSPGKGLEWIGYIYYTGSTNYNPSLESRITISVDTSKNQFSLKLKSVTAADTAVYYCARDDADYNGMDVWGQGTTVTVSS

SEQ ID NO: 4731 - DNA, 24 bp, Artificial Sequence
  synthetic
ggtggctccatcagtggttccttc

SEQ ID NO: 4732 - protein, 8 aa, Artificial Sequence
  synthetic
GGSISGSF

SEQ ID NO: 4733 - DNA, 21 bp, Artificial Sequence
  synthetic
atttattatactgggagtacc

SEQ ID NO: 4734 - protein, 7 aa, Artificial Sequence
  synthetic
IYYTGST

SEQ ID NO: 4735 - DNA, 36 bp, Artificial Sequence; identical to SEQ ID NO: 4511
  synthetic

SEQ ID NO: 4736 - protein, 12 aa, Artificial Sequence
  synthetic
ARDDADYNGMDV

SEQ ID NO: 4737 - DNA, 339 bp, Artificial Sequence
  synthetic
gacatcgtgatgacccagtctccagtctccctgtccgtcacccttggacagccggcctccatctcctgcaggtctagtcaaagcctcgtatacagtgatggaaaaacctacttaaattggtttcagcagaggccaggccaatctccaaggcgcctaatttataaggtttctaaacgggactctggggtcccggacagattcagcggcagtgggtcaggcactgatttcacactgaaaatcagcagggttgaggctgaggatgttggaatttattactgcatgcaaagtacagactggccgctcactttcggcggagggaccaaggtggagatcaaacga

SEQ ID NO: 4738 - protein, 113 aa, Artificial Sequence
  synthetic
DIVMTQSPVSLSVTLGQPASISCRSSQSLVYSDGKTYLNWFQQRPGQSPRRLIYKVSKRDSGVPDRFSGSGSGTDFTLKISRVEAEDVGIYYCMQSTDWPLTFGGGTKVEIKR

SEQ ID NO: 4739 - DNA, 33 bp, Artificial Sequence; identical to SEQ ID NO: 4515
  synthetic

SEQ ID NO: 4740 - protein, 11 aa, Artificial Sequence
  synthetic
QSLVYSDGKTY

SEQ ID NO: 4741 - DNA, 9 bp, Artificial Sequence
  synthetic
aaggtttct

SEQ ID NO: 4742 - protein, 3 aa, Artificial Sequence
  synthetic
KVS

SEQ ID NO: 4743 - DNA, 27 bp, Artificial Sequence
  synthetic
atgcaaagtacagactggccgctcact

SEQ ID NO: 4744 - protein, 9 aa, Artificial Sequence
  synthetic
MQSTDWPLT

SEQ ID NO: 4745 - DNA, 351 bp, Artificial Sequence
  synthetic
gaggtgcagctggtggagtctggacctgaggtgaagaagcctggggcctcagtgaaggtctcctgcaaggcttcgcattacacctttaccacctatggtatcagttgggtgcgacaggcccctggacaagggcttgagtggatgggatggatcagcggttacaatggtaacggaaaccttgtaaagaagttccaggacagagtcaccacggccacagacacatccacgaacacagtctacatggagctgaggagcctgagatctgacgacacggccatatattactgtgctcgaaatcgtcttgattcttttgatgtttggggccaagggacaatggtcaccgtctcctca

SEQ ID NO: 4746 - protein, 117 aa, Artificial Sequence
  synthetic
EVQLVESGPEVKKPGASVKVSCKASHYTFTTYGISWVRQAPGQGLEWMGWISGYNGNGNLVKKFQDRVTTATDTSTNTVYMELRSLRSDDTAIYYCARNRLDSFDVWGQGTMVTVSS

SEQ ID NO: 4747 - DNA, 24 bp, Artificial Sequence
  synthetic
cattacacctttaccacctatggt

SEQ ID NO: 4748 - protein, 8 aa, Artificial Sequence
  synthetic
HYTFTTYG

SEQ ID NO: 4749 - DNA, 24 bp, Artificial Sequence
  synthetic
atcagcggttacaatggtaacgga

SEQ ID NO: 4750 - protein, 8 aa, Artificial Sequence
  synthetic
ISGYNGNG

SEQ ID NO: 4751 - DNA, 30 bp, Artificial Sequence
  synthetic
gctcgaaatcgtcttgattcttttgatgtt

SEQ ID NO: 4752 - protein, 10 aa, Artificial Sequence
  synthetic
ARNRLDSFDV

SEQ ID NO: 4753 - DNA, 324 bp, Artificial Sequence
  synthetic
gacatcctgatgacccagtctccatcctccctgtctgcatctgtaggagacagagtcaccttcacttgccgggcaagtcagagcattagcagttatttaaattggtatcagcagaaaccagggaaagcccctaaactcctgatctatgctgcatccagtttgcaaagtggggtcccatcaaggttcagtggcagtggatctgggacagatttcactctcaccatcagcagtctgcagcctgaagattttgcaacttactactgtcaacagagttacagtatccctcccacttttggccaggggaccaaggtggagatcaaacga

SEQ ID NO: 4754 - protein, 108 aa, Artificial Sequence
  synthetic
DILMTQSPSSLSASVGDRVTFTCRASQSISSYLNWYQQKPGKAPKLLIYAASSLQSGVPSRFSGSGSGTDFTLTISSLQPEDFATYYCQQSYSIPPTFGQGTKVEIKR

SEQ ID NO: 4755 - DNA, 18 bp, Artificial Sequence
  synthetic
cagagcattagcagttat

SEQ ID NO: 4756 - protein, 6 aa, Artificial Sequence
  synthetic
QSISSY

SEQ ID NO: 4757 - DNA, 9 bp, Artificial Sequence
  synthetic
gctgcatcc

SEQ ID NO: 4758 - protein, 3 aa, Artificial Sequence
  synthetic
AAS

SEQ ID NO: 4759 - DNA, 27 bp, Artificial Sequence
  synthetic
caacagagttacagtatccctcccact

SEQ ID NO: 4760 - protein, 9 aa, Artificial Sequence
  synthetic
QQSYSIPPT

SEQ ID NO: 4761 - DNA, 396 bp, Artificial Sequence
  synthetic
caggtgcagctggtggagtctgggcctgaggtgaagaagcctgggtcctcggtgaaggtctcctgcaaggcttctggaggcaccttcaagaaacatgctataagctgggtgcgacaggcccctggacaagggcttgagtggatgggagggatcatccctatctttgattcaacagactacgcacagaacttccagggcagagtcacgattacctcggacgaatccacgcgcacagcctacatggagatgagcagcctgagatctgaggacacggccgtatattactgtgcgagatccagtttagcaactcgtcagtgggagatattagagacggtaaactactattactacggtatggacgtctggggccaagggaccacggtcaccgtctcctca

SEQ ID NO: 4762 - protein, 132 aa, Artificial Sequence
  synthetic
QVQLVESGPEVKKPGSSVKVSCKASGGTFKKHAISWVRQAPGQGLEWMGGIIPIFDSTDYAQNFQGRVTITSDESTRTAYMEMSSLRSEDTAVYYCARSSLATRQWEILETVNYYYYGMDVWGQGTTVTVSS

SEQ ID NO: 4763 - DNA, 24 bp, Artificial Sequence
  synthetic
ggaggcaccttcaagaaacatgct

SEQ ID NO: 4764 - protein, 8 aa, Artificial Sequence
  synthetic
GGTFKKHA

SEQ ID NO: 4765 - DNA, 24 bp, Artificial Sequence
  synthetic
atcatccctatctttgattcaaca

SEQ ID NO: 4766 - protein, 8 aa, Artificial Sequence
  synthetic
IIPIFDST

SEQ ID NO: 4767 - DNA, 75 bp, Artificial Sequence
  synthetic
gcgagatccagtttagcaactcgtcagtgggagatattagagacggtaaactactattactacggtatggacgtc

SEQ ID NO: 4768 - protein, 25 aa, Artificial Sequence
  synthetic
ARSSLATRQWEILETVNYYYYGMDV

SEQ ID NO: 4769 - DNA, 321 bp, Artificial Sequence
  synthetic
gacatcctgatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctattcactttcggccctgggaccaaggtggagatcaaacga

SEQ ID NO: 4770 - protein, 107 aa, Artificial Sequence
  synthetic
DILMTQSPSSLSASVGDRVTITCQASQDISNYLNWYQQKPGKAPKLLIYDASNLETGVPSRFSGSGSGTDFTFTISSLQPEDIATYYCQQYDNLFTFGPGTKVEIKR

SEQ ID NO: 4771 - DNA, 18 bp, Artificial Sequence
  synthetic
caggacattagcaactat

SEQ ID NO: 4772 - protein, 6 aa, Artificial Sequence
  synthetic
QDISNY

SEQ ID NO: 4773 - DNA, 9 bp, Artificial Sequence
  synthetic
gatgcatcc

SEQ ID NO: 4774 - protein, 3 aa, Artificial Sequence
  synthetic
DAS

SEQ ID NO: 4775 - DNA, 24 bp, Artificial Sequence
  synthetic
caacagtatgataatctattcact

SEQ ID NO: 4776 - protein, 8 aa, Artificial Sequence
  synthetic
QQYDNLFT

SEQ ID NO: 4777 - DNA, 396 bp, Artificial Sequence
  synthetic
gaggtgcagctggtggagtctggggctgaggtgaagaagcctgggtcctcggtgaaggtctcctgcaaggcttctggaggcaccttcagcaggtatgctatcagctggatgcgacaggcccctggacaagggcttgagtggatgggagggatcatccctatatttagtacagcagactacgaacagaagtttaagggcagagtcacgattaccacggacgaatccacgggcacagcctacatggaactgagcagcctgagatctgaggacacggccgtgtattactgtgcgagagccagtctagcagctcgtcagtgggagataagagagagggtaagccactactacttcggtatggacgtctggggccaagggaccacggtcaccgtctcctca

SEQ ID NO: 4778 - protein, 132 aa, Artificial Sequence
  synthetic
EVQLVESGAEVKKPGSSVKVSCKASGGTFSRYAISWMRQAPGQGLEWMGGIIPIFSTADYEQKFKGRVTITTDESTGTAYMELSSLRSEDTAVYYCARASLAARQWEIRERVSHYYFGMDVWGQGTTVTVSS

SEQ ID NO: 4779 - DNA, 24 bp, Artificial Sequence
  synthetic
ggaggcaccttcagcaggtatgct

SEQ ID NO: 4780 - protein, 8 aa, Artificial Sequence
  synthetic
GGTFSRYA

SEQ ID NO: 4781 - DNA, 24 bp, Artificial Sequence
  synthetic
atcatccctatatttagtacagca

SEQ ID NO: 4782 - protein, 8 aa, Artificial Sequence
  synthetic
IIPIFSTA

SEQ ID NO: 4783 - DNA, 75 bp, Artificial Sequence
  synthetic
gcgagagccagtctagcagctcgtcagtgggagataagagagagggtaagccactactacttcggtatggacgtc

SEQ ID NO: 4784 - protein, 25 aa, Artificial Sequence
  synthetic
ARASLAARQWEIRERVSHYYFGMDV

SEQ ID NO: 4785 - DNA, 324 bp, Artificial Sequence
  synthetic
gacatcctgatgacccagtctccttccaccctgtctgcatctgtaggagacagagtcaccatcacttgccgggccagtcagagtattagtaactggttggcctggtatcagcagaaaccagggaaagcccctaagctcctgatctataaggcgtctagtttagaaagtggggtcccatcaaggttcagcggcagtggatctgggacagaattcactctcaccatcagcaggctgcagcctgatgattttgcaacttattactgccaacagtataatagttattctccgacgttcggccaagggaccaaggtggagatcaaacga

SEQ ID NO: 4786 - protein, 108 aa, Artificial Sequence
  synthetic
DILMTQSPSTLSASVGDRVTITCRASQSISNWLAWYQQKPGKAPKLLIYKASSLESGVPSRFSGSGSGTEFTLTISRLQPDDFATYYCQQYNSYSPTFGQGTKVEIKR

SEQ ID NO: 4787 - DNA, 18 bp, Artificial Sequence
  synthetic
cagagtattagtaactgg

SEQ ID NO: 4788 - protein, 6 aa, Artificial Sequence
  synthetic
QSISNW

SEQ ID NO: 4789 - DNA, 9 bp, Artificial Sequence
  synthetic
aaggcgtct

SEQ ID NO: 4790 - protein, 3 aa, Artificial Sequence
  synthetic
KAS

SEQ ID NO: 4791 - DNA, 27 bp, Artificial Sequence
  synthetic
caacagtataatagttattctccgacg

SEQ ID NO: 4792 - protein, 9 aa, Artificial Sequence
  synthetic
QQYNSYSPT

SEQ ID NO: 4793 - DNA, 396 bp, Artificial Sequence
  synthetic
gaggtgcagctggtggagtctggggcagaggtgaagaggcctgggtcctcggtgaaggtctcctgcaaggcttctggaggcaccttcaggaagtatgctgtcagctgggtgcgacaggcccccggacaagggcttgagtggatgggagggatcatccctatatttagtacagcagactacgaagagaaatttaagggcagagtcacgatcaccacggacgaatccacgggcacagcctacatggagctgactagcctgagatctgaggacacggccgtgtattactgtgcgagagccagtctagcagttcgtcagtgggagataagagagacgataagccactactacttcggtatggacgtctggggccaagggaccacggtcaccgtctcctca

SEQ ID NO: 4794 - protein, 132 aa, Artificial Sequence
  synthetic
EVQLVESGAEVKRPGSSVKVSCKASGGTFRKYAVSWVRQAPGQGLEWMGGIIPIFSTADYEEKFKGRVTITTDESTGTAYMELTSLRSEDTAVYYCARASLAVRQWEIRETISHYYFGMDVWGQGTTVTVSS

SEQ ID NO: 4795 - DNA, 24 bp, Artificial Sequence
  synthetic
ggaggcaccttcaggaagtatgct

SEQ ID NO: 4796 - protein, 8 aa, Artificial Sequence
  synthetic
GGTFRKYA

SEQ ID NO: 4797 - DNA, 24 bp, Artificial Sequence
  synthetic
atcatccctatatttagtacagca

SEQ ID NO: 4798 - protein, 8 aa, Artificial Sequence
  synthetic
IIPIFSTA

SEQ ID NO: 4799 - DNA, 75 bp, Artificial Sequence
  synthetic
gcgagagccagtctagcagttcgtcagtgggagataagagagacgataagccactactacttcggtatggacgtc

SEQ ID NO: 4800 - protein, 25 aa, Artificial Sequence
  synthetic
ARASLAVRQWEIRETISHYYFGMDV

SEQ ID NO: 4801 - DNA, 324 bp, Artificial Sequence
  synthetic
gacatcctgatgacccagtctccatcctccctgtctgcatctgtaggagacagagtcaccatcacttgccaggcgagtcaggacattagcaactatttaaattggtatcagcagaaattagggaaagcccctaagctcctgatctacgatgcatccaatttggaaataggggtcccatcaaggttcagtggaagtggatctgggacagattttactttcaccatcagcagcctgcagcctgaagatattgcaacatattactgtcaacagtatgataatctcccgctcactttcggcggagggaccaaggtggagatcaaacga

SEQ ID NO: 4802 - protein, 108 aa, Artificial Sequence
  synthetic
DILMTQSPSSLSASVGDRVTITCQASQDISNYLNWYQQKLGKAPKLLIYDASNLEIGVPSRFSGSGSGTDFTFTISSLQPEDIATYYCQQYDNLPLTFGGGTKVEIKR

SEQ ID NO: 4803 - DNA, 18 bp, Artificial Sequence
  synthetic
caggacattagcaactat

SEQ ID NO: 4804 - protein, 6 aa, Artificial Sequence
  synthetic
QDISNY

SEQ ID NO: 4805 - DNA, 9 bp, Artificial Sequence
  synthetic
gatgcatcc

SEQ ID NO: 4806 - protein, 3 aa, Artificial Sequence
  synthetic
DAS

SEQ ID NO: 4807 - DNA, 27 bp, Artificial Sequence
  synthetic
caacagtatgataatctcccgctcact

SEQ ID NO: 4808 - protein, 9 aa, Artificial Sequence
  synthetic
QQYDNLPLT

SEQ ID NO: 4809 - DNA, 396 bp, Artificial Sequence
  synthetic
gaggtgcagctggtggagtctgggcctgaggtgaagaagcctgggtcctcggtgaaggtctcctgcaaggcttctggaggcaccttcaacaagcatgctataagctgggtgcgacaggcccctggacaagggcttgagtggatgggagggatcatccctatctttggtacagcagactacgcacagaagttccagggcagaatcacgattaccacggacgaatccacgcgcacagcctacatggaactgcgcagcctgagatctgaggacacggccgtatattactgtgcgagatccagtttagcaactcgtcagtgggagatattagagacgataacctactactactacggtatggacgtctggggccaagggaccacggtcaccgtctcctca

SEQ ID NO: 4810 - protein, 132 aa, Artificial Sequence
  synthetic
EVQLVESGPEVKKPGSSVKVSCKASGGTFNKHAISWVRQAPGQGLEWMGGIIPIFGTADYAQKFQGRITITTDESTRTAYMELRSLRSEDTAVYYCARSSLATRQWEILETITYYYYGMDVWGQGTTVTVSS

SEQ ID NO: 4811 - DNA, 24 bp, Artificial Sequence
  synthetic
ggaggcaccttcaacaagcatgct

SEQ ID NO: 4812 - protein, 8 aa, Artificial Sequence
  synthetic
GGTFNKHA

SEQ ID NO: 4813 - DNA, 24 bp, Artificial Sequence
  synthetic
atcatccctatctttggtacagca

SEQ ID NO: 4814 - protein, 8 aa, Artificial Sequence
  synthetic
IIPIFGTA

SEQ ID NO: 4815 - DNA, 75 bp, Artificial Sequence
  synthetic
gcgagatccagtttagcaactcgtcagtgggagatattagagacgataacctactactactacggtatggacgtc

SEQ ID NO: 4816 - protein, 25 aa, Artificial Sequence
  synthetic
ARSSLATRQWEILETITYYYYGMDV

SEQ ID NO: 4817 - DNA, 324 bp, Artificial Sequence
  synthetic
gacatcgtgatgacccagtctccctccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggagtcccatcaaggttcagcggcagtggatctgggacagaattcactctcaccatcagcagcctgcagcctgatgattttgcaacttattactgccaacactataatagttattctccgacgttcggccaagggaccaaggtggagatcaaacga

SEQ ID NO: 4818 - protein, 108 aa, Artificial Sequence
  synthetic
DIVMTQSPSTLSASVGDRVTITCRASQSISSWLAWYQQKPGKAPKLLIYKASSLESGVPSRFSGSGSGTEFTLTISSLQPDDFATYYCQHYNSYSPTFGQGTKVEIKR

SEQ ID NO: 4819 - DNA, 18 bp, Artificial Sequence
  synthetic
cagagtattagtagctgg

SEQ ID NO: 4820 - protein, 6 aa, Artificial Sequence
  synthetic
QSISSW

SEQ ID NO: 4821 - DNA, 9 bp, Artificial Sequence
  synthetic
aaggcgtct

SEQ ID NO: 4822 - protein, 3 aa, Artificial Sequence
  synthetic
KAS

SEQ ID NO: 4823 - DNA, 27 bp, Artificial Sequence
  synthetic
caacactataatagttattctccgacg

SEQ ID NO: 4824 - protein, 9 aa, Artificial Sequence
  synthetic
QHYNSYSPT

SEQ ID NO: 4825 - DNA, 396 bp, Artificial Sequence
  synthetic
caggtgcagctggtggagtctggggctgaggtgaagaagcctgggtcctcggtgaaggtttcctgtaaggcttctggaggcaccttcagaagatatgctatcagttgggtgcgacaggcccctggacaagggctagagtggatgggagggatcatccctatctttgatacagcaaactacgcacagaaattccagggcagagtcacgattaccacggacgaatccacgagcacagcctacatggagctgagcagcctgagatctgaggactcggccgtgtattactgtgcgagatccagtatgacaattcgtcagtgggaaatactggagaacataaactactactattatggtatggacgtctggggccaagggtccacggtcaccgtctcctca

SEQ ID NO: 4826 - protein, 132 aa, Artificial Sequence
  synthetic
QVQLVESGAEVKKPGSSVKVSCKASGGTFRRYAISWVRQAPGQGLEWMGGIIPIFDTANYAQKFQGRVTITTDESTSTAYMELSSLRSEDSAVYYCARSSMTIRQWEILENINYYYYGMDVWGQGSTVTVSS

SEQ ID NO: 4827 - DNA, 24 bp, Artificial Sequence
  synthetic
ggaggcaccttcagaagatatgct

SEQ ID NO: 4828 - protein, 8 aa, Artificial Sequence
  synthetic
GGTFRRYA

SEQ ID NO: 4829 - DNA, 24 bp, Artificial Sequence
  synthetic
atcatccctatctttgatacagca

SEQ ID NO: 4830 - protein, 8 aa, Artificial Sequence
  synthetic
IIPIFDTA

SEQ ID NO: 4831 - DNA, 75 bp, Artificial Sequence
  synthetic
gcgagatccagtatgacaattcgtcagtgggaaatactggagaacataaactactactattatggtatggacgtc

SEQ ID NO: 4832 - protein, 25 aa, Artificial Sequence
  synthetic
ARSSMTIRQWEILENINYYYYGMDV

SEQ ID NO: 4833 - DNA, 324 bp, Artificial Sequence
  synthetic
gacatccagatgacccagtctccttccaccctgtctgcatctgtaggagacagagtcaccatcacttgccgggccagtcagagtattagtagctggttggcctggtatcagcagaaaccaggaaaagcccctaaactcctgatctatgaggcgtctagtttagacagtggggtcccatcaaggttcagcggcagtggatctgggacagaattcactctcaccatcagcagcctacagcctgatgattttgcaacttattactgccaacactataatagttattctccgacgttcggccaagggaccaaggtggagatcaaacga

SEQ ID NO: 4834 - protein, 108 aa, Artificial Sequence
  synthetic
DIQMTQSPSTLSASVGDRVTITCRASQSISSWLAWYQQKPGKAPKLLIYEASSLDSGVPSRFSGSGSGTEFTLTISSLQPDDFATYYCQHYNSYSPTFGQGTKVEIKR

SEQ ID NO: 4835 - DNA, 18 bp, Artificial Sequence
  synthetic
cagagtattagtagctgg

SEQ ID NO: 4836 - protein, 6 aa, Artificial Sequence
  synthetic
QSISSW

SEQ ID NO: 4837 - DNA, 9 bp, Artificial Sequence
  synthetic
gaggcgtct

SEQ ID NO: 4838 - protein, 3 aa, Artificial Sequence
  synthetic
EAS

SEQ ID NO: 4839 - DNA, 27 bp, Artificial Sequence
  synthetic
caacactataatagttattctccgacg

SEQ ID NO: 4840 - protein, 9 aa, Artificial Sequence
  synthetic
QHYNSYSPT

SEQ ID NO: 4841 - DNA, 396 bp, Artificial Sequence
  synthetic
gaggtgcagctggtggagtctggggctgaggtgaagaagcctgggtcctcggtgaaggtctcctgcaaggcttctggaggcaccttcagaagatatgctgtcagctgggtgcgacaggcccctggacaagggcttgagtgggtgggagggatcatccctatctttggtacagcaagctacgcacagaagttccagggcagagtcacgattagcacggacgaatccacgagcacagcctacatggagctgagcagcctgagatctgaggactcggccgtgtattactgtgcgagagccagtataacaactcgtcagtgggagatactggagaacataaactactactactacggtatggacgtctggggccaagggtccacggtcaccgtctcctca

SEQ ID NO: 4842 - protein, 132 aa, Artificial Sequence
  synthetic
EVQLVESGAEVKKPGSSVKVSCKASGGTFRRYAVSWVRQAPGQGLEWVGGIIPIFGTASYAQKFQGRVTISTDESTSTAYMELSSLRSEDSAVYYCARASITTRQWEILENINYYYYGMDVWGQGSTVTVSS

SEQ ID NO: 4843 - DNA, 24 bp, Artificial Sequence
  synthetic
ggaggcaccttcagaagatatgct

SEQ ID NO: 4844 - protein, 8 aa, Artificial Sequence
  synthetic
GGTFRRYA

SEQ ID NO: 4845 - DNA, 24 bp, Artificial Sequence
  synthetic
atcatccctatctttggtacagca

SEQ ID NO: 4846 - protein, 8 aa, Artificial Sequence
  synthetic
IIPIFGTA

SEQ ID NO: 4847 - DNA, 75 bp, Artificial Sequence
  synthetic
gcgagagccagtataacaactcgtcagtgggagatactggagaacataaactactactactacggtatggacgtc

SEQ ID NO: 4848 - protein, 25 aa, Artificial Sequence
  synthetic
ARASITTRQWEILENINYYYYGMDV

SEQ ID NO: 4849 - DNA, 324 bp, Artificial Sequence; identical to SEQ ID NO: 561
  synthetic

SEQ ID NO: 4850 - protein, 108 aa, Artificial Sequence; identical to SEQ ID NO: 562
  synthetic

SEQ ID NO: 4851 - DNA, 18 bp, Artificial Sequence
  synthetic
caggacattagcaactat

SEQ ID NO: 4852 - protein, 6 aa, Artificial Sequence
  synthetic
QDISNY

SEQ ID NO: 4853 - DNA, 9 bp, Artificial Sequence
  synthetic
gatgcatcc

SEQ ID NO: 4854 - protein, 3 aa, Artificial Sequence
  synthetic
DAS

SEQ ID NO: 4855 - DNA, 27 bp, Artificial Sequence
  synthetic
caacagtatgataatctcccgctcact

SEQ ID NO: 4856 - protein, 9 aa, Artificial Sequence
  synthetic
QQYDNLPLT

SEQ ID NO: 4857 - DNA, 372 bp, Artificial Sequence
  synthetic
caggtgcagctggtggagtcgggcccaggactggtgaagccttcggagaccctgtccctcacctgcactgtctctggtggctccatcggtaattactactggagctggatccggcagcccccaggaaagggactggagtggattggatatatctattacagtgagaacaccaactacaacccctccctcaagagtcgagtcaccatatctgtggccacgtccaagaaccagttctccctgaagttggattctgtgaccgccgcagacacggccgtgtattactgtgcgcgacatagagaagatattttgactggttattatagcggctattttgactactggggccagggaaccctggtcaccgtctcctca

SEQ ID NO: 4858 - protein, 124 aa, Artificial Sequence
  synthetic
QVQLVESGPGLVKPSETLSLTCTVSGGSIGNYYWSWIRQPPGKGLEWIGYIYYSENTNYNPSLKSRVTISVATSKNQFSLKLDSVTAADTAVYYCARHREDILTGYYSGYFDYWGQGTLVTVSS

SEQ ID NO: 4859 - DNA, 24 bp, Artificial Sequence
  synthetic
ggtggctccatcggtaattactac

SEQ ID NO: 4860 - protein, 8 aa, Artificial Sequence
  synthetic
GGSIGNYY

SEQ ID NO: 4861 - DNA, 21 bp, Artificial Sequence
  synthetic
atctattacagtgagaacacc

SEQ ID NO: 4862 - protein, 7 aa, Artificial Sequence
  synthetic
IYYSENT

SEQ ID NO: 4863 - DNA, 54 bp, Artificial Sequence
  synthetic
gcgcgacatagagaagatattttgactggttattatagcggctattttgactac

SEQ ID NO: 4864 - protein, 18 aa, Artificial Sequence
  synthetic
ARHREDILTGYYSGYFDY

SEQ ID NO: 4865 - DNA, 342 bp, Artificial Sequence
  synthetic
gacatcctgatgacccagtctccagactccctggctgtgtctctgggcgagagggccaccatcaactgcaagtccagccagagtgttttctacagctccaacaataagaactacttagcttggtaccagcagaaaccaggacagcctcctaagctgctcatttactggtcatctacccgggaatccggggtccctgaccgattcagtggcagcgggtctgggacagatttcactctcaccatcagcagcctgcaggctgaagatatggcagtttattactgtcaccaatattataatactccgtggacgttcggccaagggaccaaggtggagatcaaacga

SEQ ID NO: 4866 - protein, 114 aa, Artificial Sequence
  synthetic
DILMTQSPDSLAVSLGERATINCKSSQSVFYSSNNKNYLAWYQQKPGQPPKLLIYWSSTRESGVPDRFSGSGSGTDFTLTISSLQAEDMAVYYCHQYYNTPWTFGQGTKVEIKR

SEQ ID NO: 4867 - DNA, 36 bp, Artificial Sequence
  synthetic
cagagtgttttctacagctccaacaataagaactac

SEQ ID NO: 4868 - protein, 12 aa, Artificial Sequence
  synthetic
QSVFYSSNNKNY

SEQ ID NO: 4869 - DNA, 9 bp, Artificial Sequence
  synthetic
tggtcatct

SEQ ID NO: 4870 - protein, 3 aa, Artificial Sequence
  synthetic
WSS

SEQ ID NO: 4871 - DNA, 27 bp, Artificial Sequence
  synthetic
caccaatattataatactccgtggacg

SEQ ID NO: 4872 - protein, 9 aa, Artificial Sequence
  synthetic
HQYYNTPWT

SEQ ID NO: 4873 - DNA, 372 bp, Artificial Sequence
  synthetic
gaggtgcagctggtggagtcgggcccaggactggtgaagccttcggagaccctgtccctcacctgcactgtctctggtggctccatcagtaattactactggagctggatccggcagcccccagggaggggcctggagtggattggatatatctatgacagtgggagcactaactacaacccctccctcaagagtcgagtcatcatatcagtagacacgtccaagaaccagttctccctgaagttgagctctgtgaccgccgcagacacggccgtgtattactgtgcgagacatagagacgatattttgactggttattataccggctattttgactactggggccagggaaccacggtcaccgtctcctca

SEQ ID NO: 4874 - protein, 124 aa, Artificial Sequence
  synthetic
EVQLVESGPGLVKPSETLSLTCTVSGGSISNYYWSWIRQPPGRGLEWIGYIYDSGSTNYNPSLKSRVIISVDTSKNQFSLKLSSVTAADTAVYYCARHRDDILTGYYTGYFDYWGQGTTVTVSS

SEQ ID NO: 4875 - DNA, 24 bp, Artificial Sequence
  synthetic
ggtggctccatcagtaattactac

SEQ ID NO: 4876 - protein, 8 aa, Artificial Sequence
  synthetic
GGSISNYY

SEQ ID NO: 4877 - DNA, 21 bp, Artificial Sequence
  synthetic
atctatgacagtgggagcact

SEQ ID NO: 4878 - protein, 7 aa, Artificial Sequence
  synthetic
IYDSGST

SEQ ID NO: 4879 - DNA, 54 bp, Artificial Sequence
  synthetic
gcgagacatagagacgatattttgactggttattataccggctattttgactac

SEQ ID NO: 4880 - protein, 18 aa, Artificial Sequence
  synthetic
ARHRDDILTGYYTGYFDY

SEQ ID NO: 4881 - DNA, 342 bp, Artificial Sequence
  synthetic
gacatcctgatgacccagtctccagactccctggctgtgtctctgggcgagagggccaccatcaactgcaagtccagccagaatgttttattcaactccaacaataagaagtacttagcctggtaccagaagaaaccaggacagcctccaaagttactcatttactgggcatctacccgggaatccgggatccctgaccgattcagtggcagcgggtctgggacagatttcactctcaccatcagcagcctgcaggctgaagatgtggcagtttattactgtcagcaatattataatactccgtggacgttcggccaagggaccaaggtggagatcaaacga

SEQ ID NO: 4882 - protein, 114 aa, Artificial Sequence
  synthetic
DILMTQSPDSLAVSLGERATINCKSSQNVLFNSNNKKYLAWYQKKPGQPPKLLIYWASTRESGIPDRFSGSGSGTDFTLTISSLQAEDVAVYYCQQYYNTPWTFGQGTKVEIKR

SEQ ID NO: 4883 - DNA, 36 bp, Artificial Sequence
  synthetic
cagaatgttttattcaactccaacaataagaagtac

SEQ ID NO: 4884 - protein, 12 aa, Artificial Sequence
  synthetic
QNVLFNSNNKKY

SEQ ID NO: 4885 - DNA, 9 bp, Artificial Sequence
  synthetic
tgggcatct

SEQ ID NO: 4886 - protein, 3 aa, Artificial Sequence
  synthetic
WAS

SEQ ID NO: 4887 - DNA, 27 bp, Artificial Sequence
  synthetic
cagcaatattataatactccgtggacg

SEQ ID NO: 4888 - protein, 9 aa, Artificial Sequence
  synthetic
QQYYNTPWT

SEQ ID NO: 4889 - DNA, 372 bp, Artificial Sequence
  synthetic
caggtgcagctggtggagtcgggcccaggactggtgaagccttcggagaccctgtccctcacctgcgctgtctctggtggctccatcagtatttactactggagctggatccggcagtccccagggaagggactggagtggattgggtatatgtataacagtgggagcaccaactacaatccctccctcaagagtcgagtctccatatcagtagacacgtccaagaaccagttctccctgaagctgacctctgtgaccgccacagacacggccgtgtatttctgtgcgagacatagaaacgatattttgactggttattatagcggctacttagactactggggccagggaaccctggtcaccgtctcctca

SEQ ID NO: 4890 - protein, 124 aa, Artificial Sequence
  synthetic
QVQLVESGPGLVKPSETLSLTCAVSGGSISIYYWSWIRQSPGKGLEWIGYMYNSGSTNYNPSLKSRVSISVDTSKNQFSLKLTSVTATDTAVYFCARHRNDILTGYYSGYLDYWGQGTLVTVSS

SEQ ID NO: 4891 - DNA, 24 bp, Artificial Sequence
  synthetic
ggtggctccatcagtatttactac

SEQ ID NO: 4892 - protein, 8 aa, Artificial Sequence
  synthetic
GGSISIYY

SEQ ID NO: 4893 - DNA, 21 bp, Artificial Sequence
  synthetic
atgtataacagtgggagcacc

SEQ ID NO: 4894 - protein, 7 aa, Artificial Sequence
  synthetic
MYNSGST

SEQ ID NO: 4895 - DNA, 54 bp, Artificial Sequence
  synthetic
gcgagacatagaaacgatattttgactggttattatagcggctacttagactac

SEQ ID NO: 4896 - protein, 18 aa, Artificial Sequence
  synthetic
ARHRNDILTGYYSGYLDY

SEQ ID NO: 4897 - DNA, 342 bp, Artificial Sequence
  synthetic
gacatcctgatgacccagtctccagactccctggctgtgtctctgggcgagagggccaccatcaactgcaagtccagccagaatgttttattcaactccaacaataagaaatacttagcctggtaccagcagaaaccaggacagcctcctaagttactcgtttactgggcatctacccgggaatccgggatccctgaccgattcagtggcagcgggtctgggacagatttcactctcaccatcagcagcctgcaggctgaagatgtggcagtttattactgtcagcaatattataatactccgtggacgttcggccaagggaccaaggtggagatcaaacga

SEQ ID NO: 4898 - protein, 114 aa, Artificial Sequence
  synthetic
DILMTQSPDSLAVSLGERATINCKSSQNVLFNSNNKKYLAWYQQKPGQPPKLLVYWASTRESGIPDRFSGSGSGTDFTLTISSLQAEDVAVYYCQQYYNTPWTFGQGTKVEIKR

SEQ ID NO: 4899 - DNA, 36 bp, Artificial Sequence
  synthetic
cagaatgttttattcaactccaacaataagaaatac

SEQ ID NO: 4900 - protein, 12 aa, Artificial Sequence
  synthetic
QNVLFNSNNKKY

SEQ ID NO: 4901 - DNA, 9 bp, Artificial Sequence
  synthetic
tgggcatct

SEQ ID NO: 4902 - protein, 3 aa, Artificial Sequence
  synthetic
WAS

SEQ ID NO: 4903 - DNA, 27 bp, Artificial Sequence
  synthetic
cagcaatattataatactccgtggacg

SEQ ID NO: 4904 - protein, 9 aa, Artificial Sequence
  synthetic
QQYYNTPWT

SEQ ID NO: 4905 - DNA, 375 bp, Artificial Sequence
  synthetic
gaggtgcagctggtggagtctgggggaggcttggtacagcctggcaggtccctgagactctcctgtgcagcctctggattcacctttgatgattatgccatgaactgggtccggcaagctccagggaagggcctggagtgggtctcaggtattagttggaatagtggtagcatagggtatgcggactctgtgaagggccgattcaccatctccagggacaacgccaagaactccctgtatctgcaaatgaacagtctgagaactgaggacacggccttgtattactgtgcaaaagatggggcagtagtagcagctgctacttcctactggtacttcgatctgtggggccgtggcaccctggtcaccgtctcctca

SEQ ID NO: 4906 - protein, 125 aa, Artificial Sequence
  synthetic
EVQLVESGGGLVQPGRSLRLSCAASGFTFDDYAMNWVRQAPGKGLEWVSGISWNSGSIGYADSVKGRFTISRDNAKNSLYLQMNSLRTEDTALYYCAKDGAVVAAATSYWYFDLWGRGTLVTVSS

SEQ ID NO: 4907 - DNA, 24 bp, Artificial Sequence
  synthetic
ggattcacctttgatgattatgcc

SEQ ID NO: 4908 - protein, 8 aa, Artificial Sequence
  synthetic
GFTFDDYA

SEQ ID NO: 4909 - DNA, 24 bp, Artificial Sequence
  synthetic
attagttggaatagtggtagcata

SEQ ID NO: 4910 - protein, 8 aa, Artificial Sequence
  synthetic
ISWNSGSI

SEQ ID NO: 4911 - DNA, 54 bp, Artificial Sequence
  synthetic
gcaaaagatggggcagtagtagcagctgctacttcctactggtacttcgatctg

SEQ ID NO: 4912 - protein, 18 aa, Artificial Sequence
  synthetic
AKDGAVVAAATSYWYFDL

SEQ ID NO: 4913 - DNA, 324 bp, Artificial Sequence
  synthetic
gacatcgtgatgacccagtctccttccaccctgtctacatctgtaggagacagagtcaccatcacttgccgggccagtcagagtattagtagctggttggcctggtatcagcggaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacactataatagttattctccgacgttcggccaagggaccaaggtggagatcaaacga

SEQ ID NO: 4914 - protein, 108 aa, Artificial Sequence
  synthetic
DIVMTQSPSTLSTSVGDRVTITCRASQSISSWLAWYQRKPGKAPKLLIYKASSLESGVPSRFSGSGSGTEFTLTISSLQPDDFATYYCQHYNSYSPTFGQGTKVEIKR

SEQ ID NO: 4915 - DNA, 18 bp, Artificial Sequence
  synthetic
cagagtattagtagctgg

SEQ ID NO: 4916 - protein, 6 aa, Artificial Sequence
  synthetic
QSISSW

SEQ ID NO: 4917 - DNA, 9 bp, Artificial Sequence
  synthetic
aaggcgtct

SEQ ID NO: 4918 - protein, 3 aa, Artificial Sequence
  synthetic
KAS

SEQ ID NO: 4919 - DNA, 27 bp, Artificial Sequence
  synthetic
caacactataatagttattctccgacg

SEQ ID NO: 4920 - protein, 9 aa, Artificial Sequence
  synthetic
QHYNSYSPT

SEQ ID NO: 4921 - DNA, 360 bp, Artificial Sequence
  synthetic
gaggtgcagctggtggagtctgggggaggcttggtacagtcgggggggtccctgagactctcctgtgtagcctctggattcacctttagcaactatgccatgacctgggtctgccaggctccagggaaggggctggagtgggtctcagctattagtggtagtggtgataggacatactacgcagactccgtgaagggccgattcaccatctccagagacaattccaagaacacgctgtatctgcaaatgaacagcctgagagccgaggacacggccgtatattactgtgcgaaactagggtatagcatctcgtccccttttgactactggggccagggaaccatggtcaccgtctcctca

SEQ ID NO: 4922 - protein, 120 aa, Artificial Sequence
  synthetic
EVQLVESGGGLVQSGGSLRLSCVASGFTFSNYAMTWVCQAPGKGLEWVSAISGSGDRTYYADSVKGRFTISRDNSKNTLYLQMNSLRAEDTAVYYCAKLGYSISSPFDYWGQGTMVTVSS

SEQ ID NO: 4923 - DNA, 24 bp, Artificial Sequence
  synthetic
ggattcacctttagcaactatgcc

SEQ ID NO: 4924 - protein, 8 aa, Artificial Sequence
  synthetic
GFTFSNYA

SEQ ID NO: 4925 - DNA, 24 bp, Artificial Sequence
  synthetic
attagtggtagtggtgataggaca

SEQ ID NO: 4926 - protein, 8 aa, Artificial Sequence
  synthetic
ISGSGDRT

SEQ ID NO: 4927 - DNA, 39 bp, Artificial Sequence
  synthetic
gcgaaactagggtatagcatctcgtccccttttgactac

SEQ ID NO: 4928 - protein, 13 aa, Artificial Sequence
  synthetic
AKLGYSISSPFDY

SEQ ID NO: 4929 - DNA, 324 bp, Artificial Sequence
  synthetic
gacatcctgatgacccagtctccatcctccctgtctgcatctgtaggagacagagtcaccatcacttgccgggcaagtcagagcatgagcagctatttaaattggtatcagcagaaaccagggaaagcccctaacctcctgatctacactgcctccagtttacaaactggggtcccatcaaggttcagtggcagtggatctgggacagatttcactctcaccatcagcagtctgcaacctgaagactttgcaacttacttctgtcaacagagttacggtacccctcccactttcggcggagggaccaaggtggagatcaaacga

SEQ ID NO: 4930 - protein, 108 aa, Artificial Sequence
  synthetic
DILMTQSPSSLSASVGDRVTITCRASQSMSSYLNWYQQKPGKAPNLLIYTASSLQTGVPSRFSGSGSGTDFTLTISSLQPEDFATYFCQQSYGTPPTFGGGTKVEIKR

SEQ ID NO: 4931 - DNA, 18 bp, Artificial Sequence
  synthetic
cagagcatgagcagctat

SEQ ID NO: 4932 - protein, 6 aa, Artificial Sequence
  synthetic
QSMSSY

SEQ ID NO: 4933 - DNA, 9 bp, Artificial Sequence
  synthetic
actgcctcc

SEQ ID NO: 4934 - protein, 3 aa, Artificial Sequence
  synthetic
TAS

SEQ ID NO: 4935 - DNA, 27 bp, Artificial Sequence
  synthetic
caacagagttacggtacccctcccact

SEQ ID NO: 4936 - protein, 9 aa, Artificial Sequence
  synthetic
QQSYGTPPT

SEQ ID NO: 4937 - DNA, 375 bp, Artificial Sequence
  synthetic
caggtgcagctggtgcagtctgggggaggcttggtacagcctggcaggtccctgagactctcctgtgcagcctctggattcacctttgatgattatgccatgaactgggtccggcaaggtccagggaagggcctggagtgggtctcaggtattagttggaatagtggtagcatagggtatgcggactctgtgaagggccgattcaccatttccagagacaacgccaagaagttcctgtatctgcaaatgaacagtctgagagctgaggacacggccttgtattactgtgcaaaagatggggtagtagtagcagctgcaacttcctactggtacttcgatctctggggccgtggcaccctggtcaccgtctcctca

SEQ ID NO: 4938 - protein, 125 aa, Artificial Sequence
  synthetic
QVQLVQSGGGLVQPGRSLRLSCAASGFTFDDYAMNWVRQGPGKGLEWVSGISWNSGSIGYADSVKGRFTISRDNAKKFLYLQMNSLRAEDTALYYCAKDGVVVAAATSYWYFDLWGRGTLVTVSS

SEQ ID NO: 4939 - DNA, 24 bp, Artificial Sequence
  synthetic
ggattcacctttgatgattatgcc

SEQ ID NO: 4940 - protein, 8 aa, Artificial Sequence
  synthetic
GFTFDDYA

SEQ ID NO: 4941 - DNA, 24 bp, Artificial Sequence
  synthetic
attagttggaatagtggtagcata

SEQ ID NO: 4942 - protein, 8 aa, Artificial Sequence
  synthetic
ISWNSGSI

SEQ ID NO: 4943 - DNA, 54 bp, Artificial Sequence
  synthetic
gcaaaagatggggtagtagtagcagctgcaacttcctactggtacttcgatctc

SEQ ID NO: 4944 - protein, 18 aa, Artificial Sequence
  synthetic
AKDGVVVAAATSYWYFDL

SEQ ID NO: 4945 - DNA, 324 bp, Artificial Sequence
  synthetic
gacatccagatgacccagtctccttccaccctgtctgcatctgtaggagacagagtcaccatcacttgccgggccagtcagagtattagtagctggttggcctggtatcagcagaaaccagggaaagcccctaagttcctgatctataaggcgtctagtttagaaagtggggtcccatcaaggttcagcggcagtggatctgggacagaattcactctcaccatcagcagcctgcagcctgatgattttgcaacttattactgccaacagtataatagttattctccgacgttcggccaagggaccaaggtggagatcaaacga

SEQ ID NO: 4946 - protein, 108 aa, Artificial Sequence
  synthetic
DIQMTQSPSTLSASVGDRVTITCRASQSISSWLAWYQQKPGKAPKFLIYKASSLESGVPSRFSGSGSGTEFTLTISSLQPDDFATYYCQQYNSYSPTFGQGTKVEIKR

SEQ ID NO: 4947 - DNA, 18 bp, Artificial Sequence
  synthetic
cagagtattagtagctgg

SEQ ID NO: 4948 - protein, 6 aa, Artificial Sequence
  synthetic
QSISSW

SEQ ID NO: 4949 - DNA, 9 bp, Artificial Sequence
  synthetic
aaggcgtct

SEQ ID NO: 4950 - protein, 3 aa, Artificial Sequence
  synthetic
KAS

SEQ ID NO: 4951 - DNA, 27 bp, Artificial Sequence
  synthetic
caacagtataatagttattctccgacg

SEQ ID NO: 4952 - protein, 9 aa, Artificial Sequence
  synthetic
QQYNSYSPT

SEQ ID NO: 4953 - DNA, 348 bp, Artificial Sequence
  synthetic
caggtgcagctggtgcagtggggcgcaggactgttgaagccttcggagaccctgtccctcacctgcgctgtctatggtgggtccttcaatgattactactggagctggatccgccagtccccagggaaggggctggagtggattggggaaatcaatcatagtggaagcatcaactacaacccgtccctcaagagtcgagtcaccatatcagtggacacgtccaagaaccacttctccctgaacctgacctctgtgaccgccgcggacacggctgtatattactgtgcgagggtcaatgggaactccttggaccactggggccagggagccctggtcaccgtctcctca

SEQ ID NO: 4954 - protein, 116 aa, Artificial Sequence
  synthetic
QVQLVQWGAGLLKPSETLSLTCAVYGGSFNDYYWSWIRQSPGKGLEWIGEINHSGSINYNPSLKSRVTISVDTSKNHFSLNLTSVTAADTAVYYCARVNGNSLDHWGQGALVTVSS

SEQ ID NO: 4955 - DNA, 24 bp, Artificial Sequence
  synthetic
ggtgggtccttcaatgattactac

SEQ ID NO: 4956 - protein, 8 aa, Artificial Sequence
  synthetic
GGSFNDYY

SEQ ID NO: 4957 - DNA, 21 bp, Artificial Sequence
  synthetic
atcaatcatagtggaagcatc

SEQ ID NO: 4958 - protein, 7 aa, Artificial Sequence
  synthetic
INHSGSI

SEQ ID NO: 4959 - DNA, 30 bp, Artificial Sequence
  synthetic
gcgagggtcaatgggaactccttggaccac

SEQ ID NO: 4960 - protein, 10 aa, Artificial Sequence
  synthetic
ARVNGNSLDH

SEQ ID NO: 4961 - DNA, 324 bp, Artificial Sequence
  synthetic
gacatcctgatgacccagtctccatcctccctgtctgcatctgtaggagacagagtcaccatcacttgccgggcaagtcaggtcattagaactgatttaggctggtatcagcagaagccagggaaagcccctaagctcctgatctatgctgcatccagtttagaaagaggggtctcatcaagattcagcggcagtagatctggcacagttttcactctcaccatcagcagcctgcagcctgaagattttgcaacttattactgtctgcaagattacaattacccgctcactttcggcggagggaccaaggtggagatcaaacga

SEQ ID NO: 4962 - protein, 108 aa, Artificial Sequence
  synthetic
DILMTQSPSSLSASVGDRVTITCRASQVIRTDLGWYQQKPGKAPKLLIYAASSLERGVSSRFSGSRSGTVFTLTISSLQPEDFATYYCLQDYNYPLTFGGGTKVEIKR

SEQ ID NO: 4963 - DNA, 18 bp, Artificial Sequence
  synthetic
caggtcattagaactgat

SEQ ID NO: 4964 - protein, 6 aa, Artificial Sequence
  synthetic
QVIRTD

SEQ ID NO: 4965 - DNA, 9 bp, Artificial Sequence
  synthetic
gctgcatcc

SEQ ID NO: 4966 - protein, 3 aa, Artificial Sequence
  synthetic
AAS

SEQ ID NO: 4967 - DNA, 27 bp, Artificial Sequence
  synthetic
ctgcaagattacaattacccgctcact

SEQ ID NO: 4968 - protein, 9 aa, Artificial Sequence
  synthetic
LQDYNYPLT

SEQ ID NO: 4969 - DNA, 375 bp, Artificial Sequence
  synthetic
gaggtgcagctggtggagtctgggggaggcttggtacagcctggcaggtccctgagactctcctgtgcagcctctggattcacctttgatgattatgccatgaactgggtccggcaagctccagggaagggcctggagtgggtctcaggtattagttggaatagtggtagcataggttatgcggactctgtgaagggccgattcaccatctccagagacaacgccaagaactccctgtatctgcaaatgaacagtctgagaactgaggacacggccttgtattactgtgcaaaagatggggtagtagtagcagatgctaattcctactggtatttcgatctctggggccgtggcaccatggtcaccgtctcctca

SEQ ID NO: 4970 - protein, 125 aa, Artificial Sequence
  synthetic
EVQLVESGGGLVQPGRSLRLSCAASGFTFDDYAMNWVRQAPGKGLEWVSGISWNSGSIGYADSVKGRFTISRDNAKNSLYLQMNSLRTEDTALYYCAKDGVVVADANSYWYFDLWGRGTMVTVSS

SEQ ID NO: 4971 - DNA, 24 bp, Artificial Sequence
  synthetic
ggattcacctttgatgattatgcc

SEQ ID NO: 4972 - protein, 8 aa, Artificial Sequence
  synthetic
GFTFDDYA

SEQ ID NO: 4973 - DNA, 24 bp, Artificial Sequence
  synthetic
attagttggaatagtggtagcata

SEQ ID NO: 4974 - protein, 8 aa, Artificial Sequence
  synthetic
ISWNSGSI

SEQ ID NO: 4975 - DNA, 54 bp, Artificial Sequence
  synthetic
gcaaaagatggggtagtagtagcagatgctaattcctactggtatttcgatctc

SEQ ID NO: 4976 - protein, 18 aa, Artificial Sequence
  synthetic
AKDGVVVADANSYWYFDL

SEQ ID NO: 4977 - DNA, 324 bp, Artificial Sequence; identical to SEQ ID NO: 4785
  synthetic

SEQ ID NO: 4978 - protein, 108 aa, Artificial Sequence; identical to SEQ ID NO: 4786
  synthetic

SEQ ID NO: 4979 - DNA, 18 bp, Artificial Sequence
  synthetic
cagagtattagtaactgg

SEQ ID NO: 4980 - protein, 6 aa, Artificial Sequence
  synthetic
QSISNW

SEQ ID NO: 4981 - DNA, 9 bp, Artificial Sequence
  synthetic
aaggcgtct

SEQ ID NO: 4982 - protein, 3 aa, Artificial Sequence
  synthetic
KAS

SEQ ID NO: 4983 - DNA, 27 bp, Artificial Sequence
  synthetic
caacagtataatagttattctccgacg

SEQ ID NO: 4984 - protein, 9 aa, Artificial Sequence
  synthetic
QQYNSYSPT

SEQ ID NO: 4985 - DNA, 375 bp, Artificial Sequence
  synthetic
gaggtgcagctggtggagtctgggggaggcttggtacagcctggcaggtccctgagactctcctgtgcagcctctggattcacctttgatgattttgccatgaactgggtccggcaagctccagggaagggcctggagtgggtctcaggtattacttggaatagtggtggcatagggtatgcggactctgtgaagggccgattcaccatctccagagacaacgccaagaactccctatatctgcaaatgaacagtctgagagctgaggacacggccttgtattactgtgcaaaagatggggcagtagtagcagctgctacttcctactggtacttcgatctctggggccgtggcaccctggtcaccgtctcctca

SEQ ID NO: 4986 - protein, 125 aa, Artificial Sequence
  synthetic
EVQLVESGGGLVQPGRSLRLSCAASGFTFDDFAMNWVRQAPGKGLEWVSGITWNSGGIGYADSVKGRFTISRDNAKNSLYLQMNSLRAEDTALYYCAKDGAVVAAATSYWYFDLWGRGTLVTVSS

SEQ ID NO: 4987 - DNA, 24 bp, Artificial Sequence
  synthetic
ggattcacctttgatgattttgcc

SEQ ID NO: 4988 - protein, 8 aa, Artificial Sequence
  synthetic
GFTFDDFA

SEQ ID NO: 4989 - DNA, 24 bp, Artificial Sequence
  synthetic
attacttggaatagtggtggcata

SEQ ID NO: 4990 - protein, 8 aa, Artificial Sequence
  synthetic
ITWNSGGI

SEQ ID NO: 4991 - DNA, 54 bp, Artificial Sequence
  synthetic
gcaaaagatggggcagtagtagcagctgctacttcctactggtacttcgatctc

SEQ ID NO: 4992 - protein, 18 aa, Artificial Sequence
  synthetic
AKDGAVVAAATSYWYFDL

SEQ ID NO: 4993 - DNA, 324 bp, Artificial Sequence
  synthetic
gacatcctgatgacccagtctccttccaccctgtctgcatctgtaggagacagagtcaccatcacttgccgggccagtcagagtattggtagctggttggcctggtatcagcagaaaccagggaaagcccctaagttcctgatctatgaggcgtctagtttagaaagtggggtcccatcaaggttcagcggcagtggatctgggacagaattcactctcaccatcagcagcctgcagcctgatgattttgcaacttattactgccaacagtataatagttattctccgacgttcggccaagggaccaaggtggagatcaaacga

SEQ ID NO: 4994 - protein, 108 aa, Artificial Sequence
  synthetic
DILMTQSPSTLSASVGDRVTITCRASQSIGSWLAWYQQKPGKAPKFLIYEASSLESGVPSRFSGSGSGTEFTLTISSLQPDDFATYYCQQYNSYSPTFGQGTKVEIKR

SEQ ID NO: 4995 - DNA, 18 bp, Artificial Sequence
  synthetic
cagagtattggtagctgg

SEQ ID NO: 4996 - protein, 6 aa, Artificial Sequence
  synthetic
QSIGSW

SEQ ID NO: 4997 - DNA, 9 bp, Artificial Sequence
  synthetic
gaggcgtct

SEQ ID NO: 4998 - protein, 3 aa, Artificial Sequence
  synthetic
EAS

SEQ ID NO: 4999 - DNA, 27 bp, Artificial Sequence
  synthetic
caacagtataatagttattctccgacg

SEQ ID NO: 5000 - protein, 9 aa, Artificial Sequence
  synthetic
QQYNSYSPT

SEQ ID NO: 5001 - DNA, 375 bp, Artificial Sequence
  synthetic
gaggtgcagctggtggagtctgggggaggcttggtacagcctggcaggtccctgagactctcctgtgcagcctctggattcacctttgatgattatgccatgaactgggtccggcaagctccagggaagggcctggagtgggtctcaggtattagttggaatagtggtagcatagggtatgcggactctgtgaagggccgattcaccatctccagagacaacgccaagaactccctgtatctgcaaatgaacagtctgagagctgaggacacggccttgtattactgtgcaaaagatggggtagtagtagcagctgctacttcctactggtacttcgatctctggggccgtggcaccctggtcaccgtctcctca

SEQ ID NO: 5002 - protein, 125 aa, Artificial Sequence
  synthetic
EVQLVESGGGLVQPGRSLRLSCAASGFTFDDYAMNWVRQAPGKGLEWVSGISWNSGSIGYADSVKGRFTISRDNAKNSLYLQMNSLRAEDTALYYCAKDGVVVAAATSYWYFDLWGRGTLVTVSS

SEQ ID NO: 5003 - DNA, 24 bp, Artificial Sequence
  synthetic
ggattcacctttgatgattatgcc

SEQ ID NO: 5004 - protein, 8 aa, Artificial Sequence
  synthetic
GFTFDDYA

SEQ ID NO: 5005 - DNA, 24 bp, Artificial Sequence
  synthetic
attagttggaatagtggtagcata

SEQ ID NO: 5006 - protein, 8 aa, Artificial Sequence
  synthetic
ISWNSGSI

SEQ ID NO: 5007 - DNA, 54 bp, Artificial Sequence
  synthetic
gcaaaagatggggtagtagtagcagctgctacttcctactggtacttcgatctc

SEQ ID NO: 5008 - protein, 18 aa, Artificial Sequence
  synthetic
AKDGVVVAAATSYWYFDL

SEQ ID NO: 5009 - DNA, 324 bp, Artificial Sequence
  synthetic
gacatccagatgacccagtctccctccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggagtcccatcaaggttcagcggcagtggatctgggacagaattcactctcaccatcagcagcctgcagcctgatgattttgcaacttattactgccaacactataatagttattctccgacgttcggccaagggaccaaggtggagatcaaacga

SEQ ID NO: 5010 - protein, 108 aa, Artificial Sequence
  synthetic
DIQMTQSPSTLSASVGDRVTITCRASQSISSWLAWYQQKPGKAPKLLIYKASSLESGVPSRFSGSGSGTEFTLTISSLQPDDFATYYCQHYNSYSPTFGQGTKVEIKR

SEQ ID NO: 5011 - DNA, 18 bp, Artificial Sequence
  synthetic
cagagtattagtagctgg

SEQ ID NO: 5012 - protein, 6 aa, Artificial Sequence
  synthetic
QSISSW

SEQ ID NO: 5013 - DNA, 9 bp, Artificial Sequence
  synthetic
aaggcgtct

SEQ ID NO: 5014 - protein, 3 aa, Artificial Sequence
  synthetic
KAS

SEQ ID NO: 5015 - DNA, 27 bp, Artificial Sequence
  synthetic
caacactataatagttattctccgacg

SEQ ID NO: 5016 - protein, 9 aa, Artificial Sequence
  synthetic
QHYNSYSPT

SEQ ID NO: 5017 - DNA, 372 bp, Artificial Sequence
  synthetic
gaggtgcagctggtggagtcgggcccaggactggtgaagccttcggagaccctgtccctcacctgcactgtctctggtggctccatcagtaattactactggagctggatccgggagcccccagggaagggactggagtggattggatatatctataacagtgggagcaccaactacaacccctccctcaagagtcgagtcatcatatcaggagacacgtccaagaaccagttctccctgaagttgagctctgtgaccgccgcagacacggccgtgtattactgtgcgagacatagagacgatattctgactggttattatagcggctattttgaccactggggccaggggaccctggtcaccgtctcctca

SEQ ID NO: 5018 - protein, 124 aa, Artificial Sequence
  synthetic
EVQLVESGPGLVKPSETLSLTCTVSGGSISNYYWSWIREPPGKGLEWIGYIYNSGSTNYNPSLKSRVIISGDTSKNQFSLKLSSVTAADTAVYYCARHRDDILTGYYSGYFDHWGQGTLVTVSS

SEQ ID NO: 5019 - DNA, 24 bp, Artificial Sequence
  synthetic
ggtggctccatcagtaattactac

SEQ ID NO: 5020 - protein, 8 aa, Artificial Sequence
  synthetic
GGSISNYY

SEQ ID NO: 5021 - DNA, 21 bp, Artificial Sequence
  synthetic
atctataacagtgggagcacc

SEQ ID NO: 5022 - protein, 7 aa, Artificial Sequence
  synthetic
IYNSGST

SEQ ID NO: 5023 - DNA, 54 bp, Artificial Sequence
  synthetic
gcgagacatagagacgatattctgactggttattatagcggctattttgaccac

SEQ ID NO: 5024 - protein, 18 aa, Artificial Sequence
  synthetic
ARHRDDILTGYYSGYFDH

SEQ ID NO: 5025 - DNA, 342 bp, Artificial Sequence
  synthetic
gacatcgtgatgacccagtctccagactccctggctgtgtctctgggcgagagggccaccatcaactgcaagtccaagtacaatattttatacagctccaacaataagaactacttagcttggtaccagcagaaaccgggacagtctcctaaactgctcatttactgggcatctacccgggaattcggggtccctgaccgattcagcggcagcgggtctgggacagatttcactctcaccatcagcagcctgcaggctgaagatgtggcagtttattactgtcaacaatcttataatactccgtacacttttggccaggggaccaaggtggagatcaaacga

SEQ ID NO: 5026 - protein, 114 aa, Artificial Sequence
  synthetic
DIVMTQSPDSLAVSLGERATINCKSKYNILYSSNNKNYLAWYQQKPGQSPKLLIYWASTREFGVPDRFSGSGSGTDFTLTISSLQAEDVAVYYCQQSYNTPYTFGQGTKVEIKR

SEQ ID NO: 5027 - DNA, 36 bp, Artificial Sequence
  synthetic
tacaatattttatacagctccaacaataagaactac

SEQ ID NO: 5028 - protein, 12 aa, Artificial Sequence
  synthetic
YNILYSSNNKNY

SEQ ID NO: 5029 - DNA, 9 bp, Artificial Sequence
  synthetic
tgggcatct

SEQ ID NO: 5030 - protein, 3 aa, Artificial Sequence
  synthetic
WAS

SEQ ID NO: 5031 - DNA, 27 bp, Artificial Sequence
  synthetic
caacaatcttataatactccgtacact

SEQ ID NO: 5032 - protein, 9 aa, Artificial Sequence
  synthetic
QQSYNTPYT

SEQ ID NO: 5033 - DNA, 375 bp, Artificial Sequence
  synthetic
gaggtgcagctggtggagtctgggggaggcttggtacagcctggcaggtccctgagactctcctgtgcagcctctggattcacctttgatgattatgccatgaactgggtccggcaagctccagggaagggcctggagtgggtctcaggtattagttggaatagtggtagcatagggtatgcggactctgtgaagggccgattcaccatctccagggacaacgccaagaactccctgtatctgcaaatgaacagtctgagaactgaggacacggcctggtattactgtgcaaaagatggggcagtagtagccgctgctacttcccactggtacttcgatctgtggggccgtggcaccatggtcaccgtctcctca

SEQ ID NO: 5034 - protein, 125 aa, Artificial Sequence
  synthetic
EVQLVESGGGLVQPGRSLRLSCAASGFTFDDYAMNWVRQAPGKGLEWVSGISWNSGSIGYADSVKGRFTISRDNAKNSLYLQMNSLRTEDTAWYYCAKDGAVVAAATSHWYFDLWGRGTMVTVSS

SEQ ID NO: 5035 - DNA, 24 bp, Artificial Sequence
  synthetic
ggattcacctttgatgattatgcc

SEQ ID NO: 5036 - protein, 8 aa, Artificial Sequence
  synthetic
GFTFDDYA

SEQ ID NO: 5037 - DNA, 24 bp, Artificial Sequence
  synthetic
attagttggaatagtggtagcata

SEQ ID NO: 5038 - protein, 8 aa, Artificial Sequence
  synthetic
ISWNSGSI

SEQ ID NO: 5039 - DNA, 54 bp, Artificial Sequence
  synthetic
gcaaaagatggggcagtagtagccgctgctacttcccactggtacttcgatctg

SEQ ID NO: 5040 - protein, 18 aa, Artificial Sequence
  synthetic
AKDGAVVAAATSHWYFDL

SEQ ID NO: 5041 - DNA, 324 bp, Artificial Sequence
  synthetic
gacatccagatgacccagtctccttccaccctgtctacatctgtaggagacagagtcaccatcacttgccgggccagtcagagtattagtagctggttggcctggtatcagcggaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacactataatagttattctccgacgttcggccaagggaccaaggtggagatcaaacga

SEQ ID NO: 5042 - protein, 108 aa, Artificial Sequence
  synthetic
DIQMTQSPSTLSTSVGDRVTITCRASQSISSWLAWYQRKPGKAPKLLIYKASSLESGVPSRFSGSGSGTEFTLTISSLQPDDFATYYCQHYNSYSPTFGQGTKVEIKR

SEQ ID NO: 5043 - DNA, 18 bp, Artificial Sequence
  synthetic
cagagtattagtagctgg

SEQ ID NO: 5044 - protein, 6 aa, Artificial Sequence
  synthetic
QSISSW

SEQ ID NO: 5045 - DNA, 9 bp, Artificial Sequence
  synthetic
aaggcgtct

SEQ ID NO: 5046 - protein, 3 aa, Artificial Sequence
  synthetic
KAS

SEQ ID NO: 5047 - DNA, 27 bp, Artificial Sequence
  synthetic
caacactataatagttattctccgacg

SEQ ID NO: 5048 - protein, 9 aa, Artificial Sequence
  synthetic
QHYNSYSPT

SEQ ID NO: 5049 - DNA, 381 bp, Artificial Sequence
  synthetic
gaggtgcagctggtggagtctggaggaggcgtggtccagcctgggaggtccctgagactctcctgtgcagcgtctggattcaccttcagtagttatggcatgcactgggtccgccaggctccaggcaaggggctggagtgggtggcagttatatggtatgatggaagtaataaatactatgcagagtccgtgaagggccgattcaccatctccagagacaattccaagaacacgctgtatctgcaaatgaacagcctgagagccgaagacacggctgtgtattactgtgcgagagagtctctctctacgcacggtcccctttactactactactacggcatggacgtctggggccaagggaccacggtcaccgtctcctca

SEQ ID NO: 5050 - protein, 127 aa, Artificial Sequence
  synthetic
EVQLVESGGGVVQPGRSLRLSCAASGFTFSSYGMHWVRQAPGKGLEWVAVIWYDGSNKYYAESVKGRFTISRDNSKNTLYLQMNSLRAEDTAVYYCARESLSTHGPLYYYYYGMDVWGQGTTVTVSS

SEQ ID NO: 5051 - DNA, 24 bp, Artificial Sequence
  synthetic
ggattcaccttcagtagttatggc

SEQ ID NO: 5052 - protein, 8 aa, Artificial Sequence
  synthetic
GFTFSSYG

SEQ ID NO: 5053 - DNA, 24 bp, Artificial Sequence
  synthetic
atatggtatgatggaagtaataaa

SEQ ID NO: 5054 - protein, 8 aa, Artificial Sequence
  synthetic
IWYDGSNK

SEQ ID NO: 5055 - DNA, 60 bp, Artificial Sequence
  synthetic
gcgagagagtctctctctacgcacggtcccctttactactactactacggcatggacgtc

SEQ ID NO: 5056 - protein, 20 aa, Artificial Sequence
  synthetic
ARESLSTHGPLYYYYYGMDV

SEQ ID NO: 5057 - DNA, 324 bp, Artificial Sequence
  synthetic
gacatccagatgacccagtctccatcctccctgtctgcatctgtaggagacagactcaccatcacttgccgggcaagtcagaccattagcagctatttaaattggtatcagcagaaaccagggaaagcccctaaactcctgatctatgctgcatccagtttggaaagtggggtcccatcaaggttcagtggcagtggatctgggacagatttcactctcaccatcagcagtctgcaacctgaagattttgcaacttactattgtcaagagagttacaatacccctctcacttttggccaggggaccaaggtggagatcaaacga

SEQ ID NO: 5058 - protein, 108 aa, Artificial Sequence
  synthetic
DIQMTQSPSSLSASVGDRLTITCRASQTISSYLNWYQQKPGKAPKLLIYAASSLESGVPSRFSGSGSGTDFTLTISSLQPEDFATYYCQESYNTPLTFGQGTKVEIKR

SEQ ID NO: 5059 - DNA, 18 bp, Artificial Sequence
  synthetic
cagaccattagcagctat

SEQ ID NO: 5060 - protein, 6 aa, Artificial Sequence
  synthetic
QTISSY

SEQ ID NO: 5061 - DNA, 9 bp, Artificial Sequence
  synthetic
gctgcatcc

SEQ ID NO: 5062 - protein, 3 aa, Artificial Sequence
  synthetic
AAS

SEQ ID NO: 5063 - DNA, 27 bp, Artificial Sequence
  synthetic
caagagagttacaatacccctctcact

SEQ ID NO: 5064 - protein, 9 aa, Artificial Sequence
  synthetic
QESYNTPLT

SEQ ID NO: 5065 - DNA, 372 bp, Artificial Sequence
  synthetic
gaggtgcagctggtggagtcgggcccaggactggtgaagccttcggagaccctgtccctcacctgcgctgtctctggtggctccatcagtatttactactggagctggatccggcagtccccagggaagggactggagtggattgggtatatgtataacagtgggaccaccaagtacaatccctccctcaagagtcgagtctccatatcagtagacacgtccaagaaccagttctccctgaagctgacctctgtgaccgccacagacacggccgtgtatttctgtgcgcgacatagaaacgatcttttgactggttattatagcggctacttagactactggggccagggaaccatggtcaccgtctcctca

SEQ ID NO: 5066 - protein, 124 aa, Artificial Sequence
  synthetic
EVQLVESGPGLVKPSETLSLTCAVSGGSISIYYWSWIRQSPGKGLEWIGYMYNSGTTKYNPSLKSRVSISVDTSKNQFSLKLTSVTATDTAVYFCARHRNDLLTGYYSGYLDYWGQGTMVTVSS

SEQ ID NO: 5067 - DNA, 24 bp, Artificial Sequence
  synthetic
ggtggctccatcagtatttactac

SEQ ID NO: 5068 - protein, 8 aa, Artificial Sequence
  synthetic
GGSISIYY

SEQ ID NO: 5069 - DNA, 21 bp, Artificial Sequence
  synthetic
atgtataacagtgggaccacc

SEQ ID NO: 5070 - protein, 7 aa, Artificial Sequence
  synthetic
MYNSGTT

SEQ ID NO: 5071 - DNA, 54 bp, Artificial Sequence
  synthetic
gcgcgacatagaaacgatcttttgactggttattatagcggctacttagactac

SEQ ID NO: 5072 - protein, 18 aa, Artificial Sequence
  synthetic
ARHRNDLLTGYYSGYLDY

SEQ ID NO: 5073 - DNA, 342 bp, Artificial Sequence
  synthetic
gacatcctgatgacccagtctccagactccctggctgtgtctctgggcgagagggccaccatcgactgcaagtccagccacagtgttttatacagctccaacaataagaattacttagcttggtaccagcagaaaccaggacagcctcctaaactgctcatttactgggcatctatccgggattccggggtccctgaccgattcagtggcagcgggtctgggacagatttcactctcaccatcagcagcctgcagtctgaagatgtggcagtttatttctgtcagcagtcttataatgctccgtacacttttggccaggggaccaaggtggagatcaaacga

SEQ ID NO: 5074 - protein, 114 aa, Artificial Sequence
  synthetic
DILMTQSPDSLAVSLGERATIDCKSSHSVLYSSNNKNYLAWYQQKPGQPPKLLIYWASIRDSGVPDRFSGSGSGTDFTLTISSLQSEDVAVYFCQQSYNAPYTFGQGTKVEIKR

SEQ ID NO: 5075 - DNA, 36 bp, Artificial Sequence
  synthetic
cacagtgttttatacagctccaacaataagaattac

SEQ ID NO: 5076 - protein, 12 aa, Artificial Sequence
  synthetic
HSVLYSSNNKNY

SEQ ID NO: 5077 - DNA, 9 bp, Artificial Sequence
  synthetic
tgggcatct

SEQ ID NO: 5078 - protein, 3 aa, Artificial Sequence
  synthetic
WAS

SEQ ID NO: 5079 - DNA, 27 bp, Artificial Sequence
  synthetic
cagcagtcttataatgctccgtacact

SEQ ID NO: 5080 - protein, 9 aa, Artificial Sequence
  synthetic
QQSYNAPYT

SEQ ID NO: 5081 - DNA, 375 bp, Artificial Sequence
  synthetic
gaggtgcagctggtggagtctgggggaggcttggtacagcctggcaggtccctgagactctcctgtgcagcctctggattcacctttgatgattatgccatgaactgggtccggcaagctccagggaagggcctggagtgggtctcaggtattacttggaatagtggtagcatagggtatgcggactctgtgaagggccgattcaccatctccagagacaacgccaagaactccctgtatctggaaatgaacagtctgagagctgaggacacggccttgtattactgtgcaaaagatggggtagtagtagcagctgctacttcctactggtacttcgatctctggggccgtggcaccctggtcaccgtctcctca

SEQ ID NO: 5082 - protein, 125 aa, Artificial Sequence
  synthetic
EVQLVESGGGLVQPGRSLRLSCAASGFTFDDYAMNWVRQAPGKGLEWVSGITWNSGSIGYADSVKGRFTISRDNAKNSLYLEMNSLRAEDTALYYCAKDGVVVAAATSYWYFDLWGRGTLVTVSS

SEQ ID NO: 5083 - DNA, 24 bp, Artificial Sequence
  synthetic
ggattcacctttgatgattatgcc

SEQ ID NO: 5084 - protein, 8 aa, Artificial Sequence
  synthetic
GFTFDDYA

SEQ ID NO: 5085 - DNA, 24 bp, Artificial Sequence
  synthetic
attacttggaatagtggtagcata

SEQ ID NO: 5086 - protein, 8 aa, Artificial Sequence
  synthetic
ITWNSGSI

SEQ ID NO: 5087 - DNA, 54 bp, Artificial Sequence; identical to SEQ ID NO: 5007
  synthetic

SEQ ID NO: 5088 - protein, 18 aa, Artificial Sequence
  synthetic
AKDGVVVAAATSYWYFDL

SEQ ID NO: 5089 - DNA, 324 bp, Artificial Sequence
  synthetic
gacatcctgatgacccagtctccttccaccctgtctgcatctgtaggagacagagtcaccatcacttgccgggccagtcagagtattagtagctggttggcctggtatcagcagaaaccaggaaaagcccctaaactcctgatctatgaggcgtctagtttagacagtggggtcccatcaaggttcagcggcagtggatctgggacagaattcactctcaccatcagcagcctacagcctgatgattttgcaacttattactgccaacactataatagttattctccgacgttcggccaagggaccaaggtggagatcaaacga

SEQ ID NO: 5090 - protein, 108 aa, Artificial Sequence
  synthetic
DILMTQSPSTLSASVGDRVTITCRASQSISSWLAWYQQKPGKAPKLLIYEASSLDSGVPSRFSGSGSGTEFTLTISSLQPDDFATYYCQHYNSYSPTFGQGTKVEIKR

SEQ ID NO: 5091 - DNA, 18 bp, Artificial Sequence
  synthetic
cagagtattagtagctgg

SEQ ID NO: 5092 - protein, 6 aa, Artificial Sequence
  synthetic
QSISSW

SEQ ID NO: 5093 - DNA, 9 bp, Artificial Sequence
  synthetic
gaggcgtct

SEQ ID NO: 5094 - protein, 3 aa, Artificial Sequence
  synthetic
EAS

SEQ ID NO: 5095 - DNA, 27 bp, Artificial Sequence
  synthetic
caacactataatagttattctccgacg

SEQ ID NO: 5096 - protein, 9 aa, Artificial Sequence
  synthetic
QHYNSYSPT

SEQ ID NO: 5097 - DNA, 375 bp, Artificial Sequence
  synthetic
gaggtgcagctggtggagtctgggggaggcttggtacagcctggcaggtccctgagactctcctgtgcagcctctggattcacctttgatgattttgccatgaactgggtccggcaagctccagggaagggcctggagtgggtctcaggtattacttggaatagtggtagtatagggtatgcggactctgtgaagggccgattcaccatctccagagacaacgccaagaactccctatatctgcaaatgaacagtctgagaactgaggacacggccttgtattactgtgcaaaagatggggcagtagtagcagctgctacttcctactggtacttcgatctctggggccgtggcaccatggtcaccgtctcctca

SEQ ID NO: 5098 - protein, 125 aa, Artificial Sequence
  synthetic
EVQLVESGGGLVQPGRSLRLSCAASGFTFDDFAMNWVRQAPGKGLEWVSGITWNSGSIGYADSVKGRFTISRDNAKNSLYLQMNSLRTEDTALYYCAKDGAVVAAATSYWYFDLWGRGTMVTVSS

SEQ ID NO: 5099 - DNA, 24 bp, Artificial Sequence
  synthetic
ggattcacctttgatgattttgcc

SEQ ID NO: 5100 - protein, 8 aa, Artificial Sequence
  synthetic
GFTFDDFA

SEQ ID NO: 5101 - DNA, 24 bp, Artificial Sequence
  synthetic
attacttggaatagtggtagtata

SEQ ID NO: 5102 - protein, 8 aa, Artificial Sequence
  synthetic
ITWNSGSI

SEQ ID NO: 5103 - DNA, 54 bp, Artificial Sequence; identical to SEQ ID NO: 4991
  synthetic

SEQ ID NO: 5104 - protein, 18 aa, Artificial Sequence
  synthetic
AKDGAVVAAATSYWYFDL

SEQ ID NO: 5105 - DNA, 324 bp, Artificial Sequence
  synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgctcactttcggcggagggaccaaggtggagatcaaacga

SEQ ID NO: 5106 - protein, 108 aa, Artificial Sequence
  synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIKR

SEQ ID NO: 5107 - DNA, 18 bp, Artificial Sequence
  synthetic
caggacattagcaactat

SEQ ID NO: 5108 - protein, 6 aa, Artificial Sequence
  synthetic
QDISNY

SEQ ID NO: 5109 - DNA, 9 bp, Artificial Sequence
  synthetic
gatgcatcc

SEQ ID NO: 5110 - protein, 3 aa, Artificial Sequence
  synthetic
DAS

SEQ ID NO: 5111 - DNA, 27 bp, Artificial Sequence
  synthetic
caacagtatgataatctcccgctcact

SEQ ID NO: 5112 - protein, 9 aa, Artificial Sequence
  synthetic
QQYDNLPLT

SEQ ID NO: 5113 - DNA, 375 bp, Artificial Sequence
  synthetic
gaggtgcagctggtggagtctgggggaggcttggtacagcctggcaggtccctgagactctcctgtgcagcctctggattcacctttgatgactttgccatgaactgggtccggcaagctccagggaagggcctggagtgggtctcaggtatcacttggaatagtggtagcatagggtatgcggactctgtgaagggccgattcaccatctccagagacaacgccaagaattccctatatctgcaaatgaacagtctgagagctgaggacacggccttgtattactgtgcaaaagatggggcagtagtagcagctgctacttcctactggtacttcgatctctggggccgtggcaccctggtcaccgtctcctca

SEQ ID NO: 5114 - protein, 125 aa, Artificial Sequence
  synthetic
EVQLVESGGGLVQPGRSLRLSCAASGFTFDDFAMNWVRQAPGKGLEWVSGITWNSGSIGYADSVKGRFTISRDNAKNSLYLQMNSLRAEDTALYYCAKDGAVVAAATSYWYFDLWGRGTLVTVSS

SEQ ID NO: 5115 - DNA, 24 bp, Artificial Sequence
  synthetic
ggattcacctttgatgactttgcc

SEQ ID NO: 5116 - protein, 8 aa, Artificial Sequence
  synthetic
GFTFDDFA

SEQ ID NO: 5117 - DNA, 24 bp, Artificial Sequence
  synthetic
atcacttggaatagtggtagcata

SEQ ID NO: 5118 - protein, 8 aa, Artificial Sequence
  synthetic
ITWNSGSI

SEQ ID NO: 5119 - DNA, 54 bp, Artificial Sequence; identical to SEQ ID NO: 4991
  synthetic

SEQ ID NO: 5120 - protein, 18 aa, Artificial Sequence
  synthetic
AKDGAVVAAATSYWYFDL

SEQ ID NO: 5121 - DNA, 324 bp, Artificial Sequence
  synthetic
gacatcctgatgacccagtctccttccaccctgtctgcatctgtaggagacagagtcaccatcacttgccgggccagtcagagtattagtagctggttggcctggtatcagcagaaaccagggaaagcccctaaggtcctgatctataaggcgtctagtttagaaggtggggtcccatcaaggttcagcggcagtggatctgggacagaattcactctctccatcagcagcctgcagcctgatgattttgcaacttattactgccaacactataatagttattctccgacgttcggccaagggaccaaggtggagatcaaacga

SEQ ID NO: 5122 - protein, 108 aa, Artificial Sequence
  synthetic
DILMTQSPSTLSASVGDRVTITCRASQSISSWLAWYQQKPGKAPKVLIYKASSLEGGVPSRFSGSGSGTEFTLSISSLQPDDFATYYCQHYNSYSPTFGQGTKVEIKR

SEQ ID NO: 5123 - DNA, 18 bp, Artificial Sequence
  synthetic
cagagtattagtagctgg

SEQ ID NO: 5124 - protein, 6 aa, Artificial Sequence
  synthetic
QSISSW

SEQ ID NO: 5125 - DNA, 9 bp, Artificial Sequence
  synthetic
aaggcgtct

SEQ ID NO: 5126 - protein, 3 aa, Artificial Sequence
  synthetic
KAS

SEQ ID NO: 5127 - DNA, 27 bp, Artificial Sequence
  synthetic
caacactataatagttattctccgacg

SEQ ID NO: 5128 - protein, 9 aa, Artificial Sequence
  synthetic
QHYNSYSPT

SEQ ID NO: 5129 - DNA, 375 bp, Artificial Sequence
  synthetic
gaggtgcagctggtggagtctgggggaggcttggtacagcctggcaggtccctgagactctcctgtgcagcctctggattcacctttgatgattatgccatgaactgggtccgacaagctccagggaagggcctggagtgggtctcaggtattagttggaatagtggtagcatagggtatgcggactctgtgaagggccgattcaccatctccagagacaacgccaagaactccctgtatctgcaaatgaacagtctgagagctgaggacacggccttgtattactgtgcaaaagatggggtagtagtagcagctgctacttcctactggtacttcgatctctggggccgtggcaccctggtcaccgtctcctca

SEQ ID NO: 5130 - protein, 125 aa, Artificial Sequence; identical to SEQ ID NO: 5002
  synthetic

SEQ ID NO: 5131 - DNA, 24 bp, Artificial Sequence
  synthetic
ggattcacctttgatgattatgcc

SEQ ID NO: 5132 - protein, 8 aa, Artificial Sequence
  synthetic
GFTFDDYA

SEQ ID NO: 5133 - DNA, 24 bp, Artificial Sequence
  synthetic
attagttggaatagtggtagcata

SEQ ID NO: 5134 - protein, 8 aa, Artificial Sequence
  synthetic
ISWNSGSI

SEQ ID NO: 5135 - DNA, 54 bp, Artificial Sequence; identical to SEQ ID NO: 5007
  synthetic

SEQ ID NO: 5136 - protein, 18 aa, Artificial Sequence
  synthetic
AKDGVVVAAATSYWYFDL

SEQ ID NO: 5137 - DNA, 324 bp, Artificial Sequence
  synthetic
gacatcctgatgacccagtctccttccaccctgtctgcatctgtaggagacagagtcaccatcacttgccgggccagtcagagtattagtagctggttggcctggtatcagcagaaaccagggaaagcccctaaggtcctgatctataaggcgtctagtttagaaagtggggtcccatcaaggttcagcggcagtggatctgggacagaattcactctcaccatcagcagcctgcagcctgatgattttgcaacttattactgccaacactataatagttattctccgacgttcggccaagggaccaaggtggagatcaaacga

SEQ ID NO: 5138 - protein, 108 aa, Artificial Sequence
  synthetic
DILMTQSPSTLSASVGDRVTITCRASQSISSWLAWYQQKPGKAPKVLIYKASSLESGVPSRFSGSGSGTEFTLTISSLQPDDFATYYCQHYNSYSPTFGQGTKVEIKR

SEQ ID NO: 5139 - DNA, 18 bp, Artificial Sequence
  synthetic
cagagtattagtagctgg

SEQ ID NO: 5140 - protein, 6 aa, Artificial Sequence
  synthetic
QSISSW

SEQ ID NO: 5141 - DNA, 9 bp, Artificial Sequence
  synthetic
aaggcgtct

SEQ ID NO: 5142 - protein, 3 aa, Artificial Sequence
  synthetic
KAS

SEQ ID NO: 5143 - DNA, 27 bp, Artificial Sequence
  synthetic
caacactataatagttattctccgacg

SEQ ID NO: 5144 - protein, 9 aa, Artificial Sequence
  synthetic
QHYNSYSPT

SEQ ID NO: 5145 - DNA, 375 bp, Artificial Sequence
  synthetic
gaggtgcagctggtggagtctgggggaggcttggtacagcctggcaggtccctgagactctcctgtgcagcctctggattcacctttgatgattttgccatgaactgggtccggcaagctccagggaagggcctggagtgggtctcaggtattacttggaatagtggtagcatagggtatgcggactctgtgaagggccgattcaccatctccagagacaacgccaagaactccctatatctgcaaatgaacagtctgagagctgaggacacggccttgtattactgtgcaaaagatggggcagtagtagcagctgctacttcctactggtacttcgatctctggggccgtggcaccctggtcaccgtctcctca

SEQ ID NO: 5146 - protein, 125 aa, Artificial Sequence; identical to SEQ ID NO: 5114
  synthetic

SEQ ID NO: 5147 - DNA, 24 bp, Artificial Sequence
  synthetic
ggattcacctttgatgattttgcc

SEQ ID NO: 5148 - protein, 8 aa, Artificial Sequence
  synthetic
GFTFDDFA

SEQ ID NO: 5149 - DNA, 24 bp, Artificial Sequence
  synthetic
attacttggaatagtggtagcata

SEQ ID NO: 5150 - protein, 8 aa, Artificial Sequence
  synthetic
ITWNSGSI

SEQ ID NO: 5151 - DNA, 54 bp, Artificial Sequence; identical to SEQ ID NO: 4991
  synthetic

SEQ ID NO: 5152 - protein, 18 aa, Artificial Sequence
  synthetic
AKDGAVVAAATSYWYFDL

SEQ ID NO: 5153 - DNA, 324 bp, Artificial Sequence
  synthetic
gacatcctgatgacccagtctccttccaccctgtctacatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctccgacgttcggccaagggaccaaggtggagatcaaacga

SEQ ID NO: 5154 - protein, 108 aa, Artificial Sequence
  synthetic
DILMTQSPSTLSTSVGDRVTITCRASQSISSWLAWYQQKPGKAPKLLIYKASSLESGVPSRFSGSGSGTEFTLTISSLQPDDFATYYCQQYNSYSPTFGQGTKVEIKR

SEQ ID NO: 5155 - DNA, 18 bp, Artificial Sequence
  synthetic
cagagtattagtagctgg

SEQ ID NO: 5156 - protein, 6 aa, Artificial Sequence
  synthetic
QSISSW

SEQ ID NO: 5157 - DNA, 9 bp, Artificial Sequence
  synthetic
aaggcgtct

SEQ ID NO: 5158 - protein, 3 aa, Artificial Sequence
  synthetic
KAS

SEQ ID NO: 5159 - DNA, 27 bp, Artificial Sequence
  synthetic
caacagtataatagttattctccgacg

SEQ ID NO: 5160 - protein, 9 aa, Artificial Sequence
  synthetic
QQYNSYSPT

SEQ ID NO: 5161 - DNA, 366 bp, Artificial Sequence
  synthetic
gaggtgcagctggtggagtctggagcagaagtgaaaaagcccggggagtctctgaagatctcctgtaagggttctggatacacttttatcacctactggatcggctgggtgcgccagatgcccgggaaaggcctggagtggatgggaatcatctatcctggtgactctgataccagatatagcccgtccttccaaggccaggtcaccatctcagccgacaagtccatcaacaccgcctacctgcagtggagcagcctgaaggcctcggacaccgccatgtatttctgtgcgagactcgaaaaaataactttaaaggggggcggtatggacgtctgggcccaagggaccacggtcaccgtctcctca

SEQ ID NO: 5162 - protein, 122 aa, Artificial Sequence
  synthetic
EVQLVESGAEVKKPGESLKISCKGSGYTFITYWIGWVRQMPGKGLEWMGIIYPGDSDTRYSPSFQGQVTISADKSINTAYLQWSSLKASDTAMYFCARLEKITLKGGGMDVWAQGTTVTVSS

SEQ ID NO: 5163 - DNA, 24 bp, Artificial Sequence
  synthetic
ggatacacttttatcacctactgg

SEQ ID NO: 5164 - protein, 8 aa, Artificial Sequence
  synthetic
GYTFITYW

SEQ ID NO: 5165 - DNA, 24 bp, Artificial Sequence
  synthetic
atctatcctggtgactctgatacc

SEQ ID NO: 5166 - protein, 8 aa, Artificial Sequence
  synthetic
IYPGDSDT

SEQ ID NO: 5167 - DNA, 45 bp, Artificial Sequence
  synthetic
gcgagactcgaaaaaataactttaaaggggggcggtatggacgtc

SEQ ID NO: 5168 - protein, 15 aa, Artificial Sequence
  synthetic
ARLEKITLKGGGMDV

SEQ ID NO: 5169 - DNA, 324 bp, Artificial Sequence
  synthetic
gacatccagatgacccagtctccatcctccctgtctgcatctgtaggagacagagtcaccatcacttgccggccaagtcagaccattagcagatatttaaattggtatcagcagaaaccagggaaagcccctaagctcctcatctatactgcatccagtttgcaaagtggggtcccatcaaggttcagtggcagtggatctgggacagatttcactctcaccatcagcagtctgcaacctgaagattttgcaacttactactgtcaacagagttacagtatcccgtacacttttggccaggggaccaaggtggagatcaaacga

SEQ ID NO: 5170 - protein, 108 aa, Artificial Sequence
  synthetic
DIQMTQSPSSLSASVGDRVTITCRPSQTISRYLNWYQQKPGKAPKLLIYTASSLQSGVPSRFSGSGSGTDFTLTISSLQPEDFATYYCQQSYSIPYTFGQGTKVEIKR

SEQ ID NO: 5171 - DNA, 18 bp, Artificial Sequence
  synthetic
cagaccattagcagatat

SEQ ID NO: 5172 - protein, 6 aa, Artificial Sequence
  synthetic
QTISRY

SEQ ID NO: 5173 - DNA, 9 bp, Artificial Sequence
  synthetic
actgcatcc

SEQ ID NO: 5174 - protein, 3 aa, Artificial Sequence
  synthetic
TAS

SEQ ID NO: 5175 - DNA, 27 bp, Artificial Sequence
  synthetic
caacagagttacagtatcccgtacact

SEQ ID NO: 5176 - protein, 9 aa, Artificial Sequence
  synthetic
QQSYSIPYT

SEQ ID NO: 5177 - DNA, 366 bp, Artificial Sequence
  synthetic
caggtgcagctggtggagtctggagcagaggtgaaaaagcccggggagtctctgaagatttcctgtaagggttctggatacagttttatcacctattggatcggctgggtgcgccagatgcccgggaaaggcctggagtggatgggaatcatctatcctggtgactctaataccagatatagcccgtccttccaaggccaggtcaccatgtcagccgacaagtccatcaacaccgcctacctgcagtggagcagcctgaaggcctcggacaccgccatatattactgtgcgagactcgaaaaaataactttaaaggggggcggtatggacgtctgggcccaagggaccacggtcaccgtctcctca

SEQ ID NO: 5178 - protein, 122 aa, Artificial Sequence
  synthetic
QVQLVESGAEVKKPGESLKISCKGSGYSFITYWIGWVRQMPGKGLEWMGIIYPGDSNTRYSPSFQGQVTMSADKSINTAYLQWSSLKASDTAIYYCARLEKITLKGGGMDVWAQGTTVTVSS

SEQ ID NO: 5179 - DNA, 24 bp, Artificial Sequence
  synthetic
ggatacagttttatcacctattgg

SEQ ID NO: 5180 - protein, 8 aa, Artificial Sequence
  synthetic
GYSFITYW

SEQ ID NO: 5181 - DNA, 24 bp, Artificial Sequence
  synthetic
atctatcctggtgactctaatacc

SEQ ID NO: 5182 - protein, 8 aa, Artificial Sequence
  synthetic
IYPGDSNT

SEQ ID NO: 5183 - DNA, 45 bp, Artificial Sequence; identical to SEQ ID NO: 5167
  synthetic

SEQ ID NO: 5184 - protein, 15 aa, Artificial Sequence
  synthetic
ARLEKITLKGGGMDV

SEQ ID NO: 5185 - DNA, 324 bp, Artificial Sequence
  synthetic
gacatcctgatgacccagtctccatcctccctgtctgcatctgtaggagacagagtcaccatcacttgccggccaagtcagaccattagccgctatttaaattggtatcagcagaaaccagggaaagcccctaagctcctgatctatactgcatccagtttgcaaagtggggtcccatcaaggttcagtggcagtggatctgggacagatttcactctcaccatcagcagtctgcaacctgaagattttgcaacttactactgtcaacagagttacagtattccgtacacttttggccaggggaccaaggtggagatcaaacga

SEQ ID NO: 5186 - protein, 108 aa, Artificial Sequence
  synthetic
DILMTQSPSSLSASVGDRVTITCRPSQTISRYLNWYQQKPGKAPKLLIYTASSLQSGVPSRFSGSGSGTDFTLTISSLQPEDFATYYCQQSYSIPYTFGQGTKVEIKR

SEQ ID NO: 5187 - DNA, 18 bp, Artificial Sequence
  synthetic
cagaccattagccgctat

SEQ ID NO: 5188 - protein, 6 aa, Artificial Sequence
  synthetic
QTISRY

SEQ ID NO: 5189 - DNA, 9 bp, Artificial Sequence
  synthetic
actgcatcc

SEQ ID NO: 5190 - protein, 3 aa, Artificial Sequence
  synthetic
TAS

SEQ ID NO: 5191 - DNA, 27 bp, Artificial Sequence
  synthetic
caacagagttacagtattccgtacact

SEQ ID NO: 5192 - protein, 9 aa, Artificial Sequence
  synthetic
QQSYSIPYT

SEQ ID NO: 5193 - DNA, 366 bp, Artificial Sequence
  synthetic
gaggtgcagctggtggagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatgagcaccgcctacctgcagtggagcagtctgaaggcctcggacaccgccatgtattattgtgcgagactcgaagctataactagaaaggagggcgctatggacgtctggggccaagggaccacggtcaccgtctcctca

SEQ ID NO: 5194 - protein, 122 aa, Artificial Sequence
  synthetic
EVQLVESGAEVKKPGESLKISCKGSGYSFTSYWIGWVRQMPGKGLEWMGIIYPGDSDTRYSPSFQGQVTISADKSMSTAYLQWSSLKASDTAMYYCARLEAITRKEGAMDVWGQGTTVTVSS

SEQ ID NO: 5195 - DNA, 24 bp, Artificial Sequence
  synthetic
ggatacagctttaccagctactgg

SEQ ID NO: 5196 - protein, 8 aa, Artificial Sequence
  synthetic
GYSFTSYW

SEQ ID NO: 5197 - DNA, 24 bp, Artificial Sequence
  synthetic
atctatcctggtgactctgatacc

SEQ ID NO: 5198 - protein, 8 aa, Artificial Sequence
  synthetic
IYPGDSDT

SEQ ID NO: 5199 - DNA, 45 bp, Artificial Sequence
  synthetic
gcgagactcgaagctataactagaaaggagggcgctatggacgtc

SEQ ID NO: 5200 - protein, 15 aa, Artificial Sequence
  synthetic
ARLEAITRKEGAMDV

SEQ ID NO: 5201 - DNA, 324 bp, Artificial Sequence
  synthetic
gacatcctgatgacccagtctccatcctccctgtctgcatctgtaggagacagagtcaccatcacttgtcggacaagtcagtacattagccgctatttaaactggtatcagcagaaaccagggaaagcccctaagctcctgatctatggtgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaaggtggagatcaaacga

SEQ ID NO: 5202 - protein, 108 aa, Artificial Sequence
  synthetic
DILMTQSPSSLSASVGDRVTITCRTSQYISRYLNWYQQKPGKAPKLLIYGASSLQSGVPSRFSGSGSGTDFTLTISSLQPEDFATYYCQQSYSTPYTFGQGTKVEIKR

SEQ ID NO: 5203 - DNA, 18 bp, Artificial Sequence
  synthetic
cagtacattagccgctat

SEQ ID NO: 5204 - protein, 6 aa, Artificial Sequence
  synthetic
QYISRY

SEQ ID NO: 5205 - DNA, 9 bp, Artificial Sequence
  synthetic
ggtgcatcc

SEQ ID NO: 5206 - protein, 3 aa, Artificial Sequence
  synthetic
GAS

SEQ ID NO: 5207 - DNA, 27 bp, Artificial Sequence
  synthetic
caacagagttacagtaccccgtacact

SEQ ID NO: 5208 - protein, 9 aa, Artificial Sequence
  synthetic
QQSYSTPYT

SEQ ID NO: 5209 - DNA, 363 bp, Artificial Sequence
  synthetic
caggtgcagctggtggagtctgggggagacttggtacagccgggggggtccctgagactctcctgtgcagcctctggattcacctttaacaactatgccatgaactgggtccgccaggctccagggaaggggctggagtgggtctcagctattagtgatagtggtattggcacgtactacgcagactccgtgaagggccggttcaccatctccagagacaattccaagaacacgctgtatctgcaaatgaacagcctgagagccgaggacacggccgtatattactgtgcgaaaggtctgttcgggacctactacgccctctttgactactggggccagggaaccccggtcaccgtctcctca

SEQ ID NO: 5210 - protein, 121 aa, Artificial Sequence
  synthetic
QVQLVESGGDLVQPGGSLRLSCAASGFTFNNYAMNWVRQAPGKGLEWVSAISDSGIGTYYADSVKGRFTISRDNSKNTLYLQMNSLRAEDTAVYYCAKGLFGTYYALFDYWGQGTPVTVSS

SEQ ID NO: 5211 - DNA, 24 bp, Artificial Sequence
  synthetic
ggattcacctttaacaactatgcc

SEQ ID NO: 5212 - protein, 8 aa, Artificial Sequence
  synthetic
GFTFNNYA

SEQ ID NO: 5213 - DNA, 24 bp, Artificial Sequence
  synthetic
attagtgatagtggtattggcacg

SEQ ID NO: 5214 - protein, 8 aa, Artificial Sequence
  synthetic
ISDSGIGT

SEQ ID NO: 5215 - DNA, 42 bp, Artificial Sequence
  synthetic
gcgaaaggtctgttcgggacctactacgccctctttgactac

SEQ ID NO: 5216 - protein, 14 aa, Artificial Sequence
  synthetic
AKGLFGTYYALFDY

SEQ ID NO: 5217 - DNA, 324 bp, Artificial Sequence
  synthetic
gacatcctgatgacccagtctccatcttccgtgtctgcatctgttggagacagagtcaccatcacttgtcgggcgagtcaggatattagcagctggttagcctggtatcagcagaaaccagggaaagcccctaagctcctgatctatgttgcatccaatttgcaaagtggggtcccatcaaggttcagcggcagtggatctgggacagatttcactctcaccatcagcagcctgcagcctgaagattttgcaacttacttttgtcaacaggctaacagtttcccgatcaccttcggccaagggacacgactggagattaaacga

SEQ ID NO: 5218 - protein, 108 aa, Artificial Sequence
  synthetic
DILMTQSPSSVSASVGDRVTITCRASQDISSWLAWYQQKPGKAPKLLIYVASNLQSGVPSRFSGSGSGTDFTLTISSLQPEDFATYFCQQANSFPITFGQGTRLEIKR

SEQ ID NO: 5219 - DNA, 18 bp, Artificial Sequence
  synthetic
caggatattagcagctgg

SEQ ID NO: 5220 - protein, 6 aa, Artificial Sequence
  synthetic
QDISSW

SEQ ID NO: 5221 - DNA, 9 bp, Artificial Sequence
  synthetic
gttgcatcc

SEQ ID NO: 5222 - protein, 3 aa, Artificial Sequence
  synthetic
VAS

SEQ ID NO: 5223 - DNA, 27 bp, Artificial Sequence
  synthetic
caacaggctaacagtttcccgatcacc

SEQ ID NO: 5224 - protein, 9 aa, Artificial Sequence
  synthetic
QQANSFPIT

SEQ ID NO: 5225 - DNA, 375 bp, Artificial Sequence
  synthetic
caggtgcagctggtggagtctgggggaggcttggtaaagcctggggggtcccttagactctcctgtgcagcctctggattcactttcactaacgcctggatgagctgggtccgccagactccagggaaggggctggagtggattggccgtattagaagcaaagctgatggtgggacaacagactgcgctgcacccgtgaaaggcagattcaccatctcaagagatgattcaaaaaacacgctgtatctggaaatgaatagcctgaaaatcgaggacacagccgtttattattgtaccatagacccccataactggaggtactactactacgttatggacgtctggggccaagggaccacggtcaccgtctcctca

SEQ ID NO: 5226 - protein, 125 aa, Artificial Sequence
  synthetic
QVQLVESGGGLVKPGGSLRLSCAASGFTFTNAWMSWVRQTPGKGLEWIGRIRSKADGGTTDCAAPVKGRFTISRDDSKNTLYLEMNSLKIEDTAVYYCTIDPHNWRYYYYVMDVWGQGTTVTVSS

SEQ ID NO: 5227 - DNA, 24 bp, Artificial Sequence
  synthetic
ggattcactttcactaacgcctgg

SEQ ID NO: 5228 - protein, 8 aa, Artificial Sequence
  synthetic
GFTFTNAW

SEQ ID NO: 5229 - DNA, 30 bp, Artificial Sequence
  synthetic
attagaagcaaagctgatggtgggacaaca

SEQ ID NO: 5230 - protein, 10 aa, Artificial Sequence
  synthetic
IRSKADGGTT

SEQ ID NO: 5231 - DNA, 48 bp, Artificial Sequence
  synthetic
accatagacccccataactggaggtactactactacgttatggacgtc

SEQ ID NO: 5232 - protein, 16 aa, Artificial Sequence
  synthetic
TIDPHNWRYYYYVMDV

SEQ ID NO: 5233 - DNA, 321 bp, Artificial Sequence
  synthetic
gacatcctgatgacccagtctccatcctccctgtctgcatctgtaggagacagagtcaccatcacttgccgggcaagtcagggcaatagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagtctgcagcctgaagattttgcaacttattactgtctactgcataatgattactggacgttcggccaagggaccaaggtggagatcaaacga

SEQ ID NO: 5234 - protein, 107 aa, Artificial Sequence
  synthetic
DILMTQSPSSLSASVGDRVTITCRASQGNRNDLGWYQQKPGKAPKRLIYAASSLQSGVPSRFSGSGSGTEFTLTISSLQPEDFATYYCLLHNDYWTFGQGTKVEIKR

SEQ ID NO: 5235 - DNA, 18 bp, Artificial Sequence
  synthetic
cagggcaatagaaatgat

SEQ ID NO: 5236 - protein, 6 aa, Artificial Sequence
  synthetic
QGNRND

SEQ ID NO: 5237 - DNA, 9 bp, Artificial Sequence
  synthetic
gctgcatcc

SEQ ID NO: 5238 - protein, 3 aa, Artificial Sequence
  synthetic
AAS

SEQ ID NO: 5239 - DNA, 24 bp, Artificial Sequence
  synthetic
ctactgcataatgattactggacg

SEQ ID NO: 5240 - protein, 8 aa, Artificial Sequence
  synthetic
LLHNDYWT

SEQ ID NO: 5241 - DNA, 366 bp, Artificial Sequence
  synthetic
caggtgcagctggtggagtctggagtagaggtgaaaaagcccggggagtctctgaagatctcctgtaagggttctggatacacctttaccaaatactggatcggctgggtgcgccagatgcccgggaaaggcctggagtggatggggatcatctatcctggtgactctgatatcagatacagtccgtccttccagggccaggtcactatttcagccgacaagtccaacaacaccgccttccttcactggagcagcctgaaggcctcggacaccgccatttattactgtgcgagactcgaaactataactgggaaacagggcggtatggtcgtctggggccgagggaccacggtcaccgtctcctca

SEQ ID NO: 5242 - protein, 122 aa, Artificial Sequence
  synthetic
QVQLVESGVEVKKPGESLKISCKGSGYTFTKYWIGWVRQMPGKGLEWMGIIYPGDSDIRYSPSFQGQVTISADKSNNTAFLHWSSLKASDTAIYYCARLETITGKQGGMVVWGRGTTVTVSS

SEQ ID NO: 5243 - DNA, 24 bp, Artificial Sequence
  synthetic
ggatacacctttaccaaatactgg

SEQ ID NO: 5244 - protein, 8 aa, Artificial Sequence
  synthetic
GYTFTKYW

SEQ ID NO: 5245 - DNA, 24 bp, Artificial Sequence
  synthetic
atctatcctggtgactctgatatc

SEQ ID NO: 5246 - protein, 8 aa, Artificial Sequence
  synthetic
IYPGDSDI

SEQ ID NO: 5247 - DNA, 45 bp, Artificial Sequence
  synthetic
gcgagactcgaaactataactgggaaacagggcggtatggtcgtc

SEQ ID NO: 5248 - protein, 15 aa, Artificial Sequence
  synthetic
ARLETITGKQGGMVV

SEQ ID NO: 5249 - DNA, 321 bp, Artificial Sequence
  synthetic
gacatcctgatgacccagtctccatcctccctgtctgcatctgtaggagacagagtcaccatcacttgtcgggcaagtcagagtattagtaggtatttaaattggtatcagcagaaaccagggaaagccccaaacctcctcatctatggtgcatccggttttcaaagtggggtcccatcaaggatcagtggcagtggatctgggacagatttcactctcaccatcagcagtctgcaacctgaagattttgcaaattattactgtcaacagagttacagtacccccactttcggcggagggaccaaggtggagatcaaacga

SEQ ID NO: 5250 - protein, 107 aa, Artificial Sequence
  synthetic
DILMTQSPSSLSASVGDRVTITCRASQSISRYLNWYQQKPGKAPNLLIYGASGFQSGVPSRISGSGSGTDFTLTISSLQPEDFANYYCQQSYSTPTFGGGTKVEIKR

SEQ ID NO: 5251 - DNA, 18 bp, Artificial Sequence
  synthetic
cagagtattagtaggtat

SEQ ID NO: 5252 - protein, 6 aa, Artificial Sequence
  synthetic
QSISRY

SEQ ID NO: 5253 - DNA, 9 bp, Artificial Sequence
  synthetic
ggtgcatcc

SEQ ID NO: 5254 - protein, 3 aa, Artificial Sequence
  synthetic
GAS

SEQ ID NO: 5255 - DNA, 24 bp, Artificial Sequence
  synthetic
caacagagttacagtacccccact

SEQ ID NO: 5256 - protein, 8 aa, Artificial Sequence
  synthetic
QQSYSTPT

SEQ ID NO: 5257 - DNA, 366 bp, Artificial Sequence
  synthetic
gaggtgcagctggtggagtctggagcagaggtgaaaaagcccggggagtctctgaagatttcctgtaagggttctggatacagttttatcacctactggatcggctgggtgcgccagatgcccgggaaaggcctggagtggatgggaatcatctatcctggtgactctaataccagatatagcccgtccttccaaggccaggtcaccatgtcagccgacaagtccatcaacaccgcctacctacagtggagcagcctgaaggcctcggacaccgccatatattactgtgcgagactcgaaaaaataactttaaaggggggcggtatggacgtctgggcccaagggaccacggtcaccgtctcctca

SEQ ID NO: 5258 - protein, 122 aa, Artificial Sequence
  synthetic
EVQLVESGAEVKKPGESLKISCKGSGYSFITYWIGWVRQMPGKGLEWMGIIYPGDSNTRYSPSFQGQVTMSADKSINTAYLQWSSLKASDTAIYYCARLEKITLKGGGMDVWAQGTTVTVSS

SEQ ID NO: 5259 - DNA, 24 bp, Artificial Sequence
  synthetic
ggatacagttttatcacctactgg

SEQ ID NO: 5260 - protein, 8 aa, Artificial Sequence
  synthetic
GYSFITYW

SEQ ID NO: 5261 - DNA, 24 bp, Artificial Sequence
  synthetic
atctatcctggtgactctaatacc

SEQ ID NO: 5262 - protein, 8 aa, Artificial Sequence
  synthetic
IYPGDSNT

SEQ ID NO: 5263 - DNA, 45 bp, Artificial Sequence; identical to SEQ ID NO: 5167
  synthetic

SEQ ID NO: 5264 - protein, 15 aa, Artificial Sequence
  synthetic
ARLEKITLKGGGMDV

SEQ ID NO: 5265 - DNA, 324 bp, Artificial Sequence
  synthetic
gacatcctgatgacccagtctccatcctccctgtctgcatctgtaggagacagagtcaccatcacttgccggccaagtcagaccattagccactatttaaattggtatcagcagaaaccagggaaagcccctaagctcctgatctatactgcatccagtttgcaaagtggggtcccatcaaggttcagtggcagtggatctgggacagatttcactctcaccatcagcagtctgcaacctgaagattttgcaacttactactgtcaacagagttacagtattccgtacacttttggccaggggaccaaggtggagatcaaacga

SEQ ID NO: 5266 - protein, 108 aa, Artificial Sequence
  synthetic
DILMTQSPSSLSASVGDRVTITCRPSQTISHYLNWYQQKPGKAPKLLIYTASSLQSGVPSRFSGSGSGTDFTLTISSLQPEDFATYYCQQSYSIPYTFGQGTKVEIKR

SEQ ID NO: 5267 - DNA, 18 bp, Artificial Sequence
  synthetic
cagaccattagccactat

SEQ ID NO: 5268 - protein, 6 aa, Artificial Sequence
  synthetic
QTISHY

SEQ ID NO: 5269 - DNA, 9 bp, Artificial Sequence
  synthetic
actgcatcc

SEQ ID NO: 5270 - protein, 3 aa, Artificial Sequence
  synthetic
TAS

SEQ ID NO: 5271 - DNA, 27 bp, Artificial Sequence
  synthetic
caacagagttacagtattccgtacact

SEQ ID NO: 5272 - protein, 9 aa, Artificial Sequence
  synthetic
QQSYSIPYT

SEQ ID NO: 5273 - DNA, 357 bp, Artificial Sequence
  synthetic
caggtgcagctggtggagtctgggggaggcgtggtccagcctgggaggtccctgagactctcctgtgtagcgtctggattcaccttcagtacctatggcatgcattgggtccgccaggctccaggcaaggggctggagtgggtggcacttatttggtatgatggaagtaataaaaattatgcagactccgtgaagggccgattcaccatctccagagacaattccaagaacacgctggatctgcaaatgaacagcctgagagccgaggacacggctgtgtatcactgtgtgagagcctcctatggttccaggggtatggacgtctggggccaagggaccacggtcaccgtctcctca

SEQ ID NO: 5274 - protein, 119 aa, Artificial Sequence
  synthetic
QVQLVESGGGVVQPGRSLRLSCVASGFTFSTYGMHWVRQAPGKGLEWVALIWYDGSNKNYADSVKGRFTISRDNSKNTLDLQMNSLRAEDTAVYHCVRASYGSRGMDVWGQGTTVTVSS

SEQ ID NO: 5275 - DNA, 24 bp, Artificial Sequence
  synthetic
ggattcaccttcagtacctatggc

SEQ ID NO: 5276 - protein, 8 aa, Artificial Sequence
  synthetic
GFTFSTYG

SEQ ID NO: 5277 - DNA, 24 bp, Artificial Sequence
  synthetic
atttggtatgatggaagtaataaa

SEQ ID NO: 5278 - protein, 8 aa, Artificial Sequence
  synthetic
IWYDGSNK

SEQ ID NO: 5279 - DNA, 36 bp, Artificial Sequence
  synthetic
gtgagagcctcctatggttccaggggtatggacgtc

SEQ ID NO: 5280 - protein, 12 aa, Artificial Sequence
  synthetic
VRASYGSRGMDV

SEQ ID NO: 5281 - DNA, 339 bp, Artificial Sequence
  synthetic
gacatcgtgatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttgcactgaaaatcagcagagtggaggctgaggatgttggggtttattactgcatgcaagctctacaaactccattcactttcggccctgggaccaaggtggagatcaaacga

SEQ ID NO: 5282 - protein, 113 aa, Artificial Sequence
  synthetic
DIVMTQSPLSLPVTPGEPASISCRSSQSLLHSNGYNYLDWYLQKPGQSPQLLIYLGSNRASGVPDRFSGSGSGTDFALKISRVEAEDVGVYYCMQALQTPFTFGPGTKVEIKR

SEQ ID NO: 5283 - DNA, 33 bp, Artificial Sequence; identical to SEQ ID NO: 2259
  synthetic

SEQ ID NO: 5284 - protein, 11 aa, Artificial Sequence
  synthetic
QSLLHSNGYNY

SEQ ID NO: 5285 - DNA, 9 bp, Artificial Sequence
  synthetic
ttgggttct

SEQ ID NO: 5286 - protein, 3 aa, Artificial Sequence
  synthetic
LGS

SEQ ID NO: 5287 - DNA, 27 bp, Artificial Sequence
  synthetic
atgcaagctctacaaactccattcact

SEQ ID NO: 5288 - protein, 9 aa, Artificial Sequence
  synthetic
MQALQTPFT

SEQ ID NO: 5289 - DNA, 372 bp, Artificial Sequence
  synthetic
gaggtgcagctggtggagtcgggcccaggactggtgaagccttcggagaccctgtccctcacctgcactgtctctggtggctccatcagtagttactactggaactggatccggcagtccccagggaagggactggaatggattggttatatctatgacagtgggaacaccaaatacagtccctccctcaagagtcgagtcaccatatcagtggacacgtccaagaaccacttctccctgaagcttatctctgtgaccgctgcggacacggccgtgtattactgtgcgagagggagttacgatattttgactgcttattatagtccctggttcgactcctggggccagggaaccctggtcaccgtctcctca

SEQ ID NO: 5290 - protein, 124 aa, Artificial Sequence
  synthetic
EVQLVESGPGLVKPSETLSLTCTVSGGSISSYYWNWIRQSPGKGLEWIGYIYDSGNTKYSPSLKSRVTISVDTSKNHFSLKLISVTAADTAVYYCARGSYDILTAYYSPWFDSWGQGTLVTVSS

SEQ ID NO: 5291 - DNA, 24 bp, Artificial Sequence
  synthetic
ggtggctccatcagtagttactac

SEQ ID NO: 5292 - protein, 8 aa, Artificial Sequence
  synthetic
GGSISSYY

SEQ ID NO: 5293 - DNA, 21 bp, Artificial Sequence
  synthetic
atctatgacagtgggaacacc

SEQ ID NO: 5294 - protein, 7 aa, Artificial Sequence
  synthetic
IYDSGNT

SEQ ID NO: 5295 - DNA, 54 bp, Artificial Sequence
  synthetic
gcgagagggagttacgatattttgactgcttattatagtccctggttcgactcc

SEQ ID NO: 5296 - protein, 18 aa, Artificial Sequence
  synthetic
ARGSYDILTAYYSPWFDS

SEQ ID NO: 5297 - DNA, 342 bp, Artificial Sequence
  synthetic
gacatcgtgatgacccagtctccagactccctggctgtgtctctgggcgagagggccaccatcaactgcaagtccagccagaatgttttattcaactccaacaataagaagtacttagcctggtaccagaagaaaccaggacagcctccaaagttactcatttactgggcatctacccgggaatccgggatccctgaccgattcagtggcagcgggtctgggacagatttcactctcaccatcagcagcctgcaggctgaagatgtggcagtttattactgtcagcaatattataatactccgtggacgttcggccaagggaccaaggtggagatcaaacga

SEQ ID NO: 5298 - protein, 114 aa, Artificial Sequence
  synthetic
DIVMTQSPDSLAVSLGERATINCKSSQNVLFNSNNKKYLAWYQKKPGQPPKLLIYWASTRESGIPDRFSGSGSGTDFTLTISSLQAEDVAVYYCQQYYNTPWTFGQGTKVEIKR

SEQ ID NO: 5299 - DNA, 36 bp, Artificial Sequence; identical to SEQ ID NO: 4883
  synthetic

SEQ ID NO: 5300 - protein, 12 aa, Artificial Sequence
  synthetic
QNVLFNSNNKKY

SEQ ID NO: 5301 - DNA, 9 bp, Artificial Sequence
  synthetic
tgggcatct

SEQ ID NO: 5302 - protein, 3 aa, Artificial Sequence
  synthetic
WAS

SEQ ID NO: 5303 - DNA, 27 bp, Artificial Sequence
  synthetic
cagcaatattataatactccgtggacg

SEQ ID NO: 5304 - protein, 9 aa, Artificial Sequence
  synthetic
QQYYNTPWT

SEQ ID NO: 5305 - DNA, 354 bp, Artificial Sequence
  synthetic
caggtgcagctggtggagtcgggtccaggactggtgaagccttcggagaccctgtccctcacctgcaatgtctctggtggctccatcagtggttacttctggagttggatccggcagtccccagggaaggaactggagtggattggatatatctattacagtgggagcaccaactacaatccctccctcgagagtcgcgtcaccatgtcagtagacacgaccaataaccaggtctccctgaggctgagttctgtgaccgctgaggacacggccgtgtatttctgtgcgagagatgatgcagactacaacggtatggacgtctggggccaagggaccacggtcaccgtctcctca

SEQ ID NO: 5306 - protein, 118 aa, Artificial Sequence
  synthetic
QVQLVESGPGLVKPSETLSLTCNVSGGSISGYFWSWIRQSPGKELEWIGYIYYSGSTNYNPSLESRVTMSVDTTNNQVSLRLSSVTAEDTAVYFCARDDADYNGMDVWGQGTTVTVSS

SEQ ID NO: 5307 - DNA, 24 bp, Artificial Sequence
  synthetic
ggtggctccatcagtggttacttc

SEQ ID NO: 5308 - protein, 8 aa, Artificial Sequence
  synthetic
GGSISGYF

SEQ ID NO: 5309 - DNA, 21 bp, Artificial Sequence
  synthetic
atctattacagtgggagcacc

SEQ ID NO: 5310 - protein, 7 aa, Artificial Sequence
  synthetic
IYYSGST

SEQ ID NO: 5311 - DNA, 36 bp, Artificial Sequence
  synthetic
gcgagagatgatgcagactacaacggtatggacgtc

SEQ ID NO: 5312 - protein, 12 aa, Artificial Sequence
  synthetic
ARDDADYNGMDV

SEQ ID NO: 5313 - DNA, 339 bp, Artificial Sequence
  synthetic
gacatcgtgatgacccagtctccactctccctgcccgtcacccttggacaggcggcctccatctcctgcaggtctagtcaaagcctcctctacagtgatggaaaaatatacttgagttggtttcaccagaggccaggccaacctccaaggcgcctaatttataaggtttctaagcgggactctggggtcccagacagattcggcggcagtgggtcagacagtgacttcacactgaaaatcagcagggtggaggctgaggatgttgggatttattactgcatgcaaggtacacactggccgctcactttcggcggagggaccaaggtggagatcaaacga

SEQ ID NO: 5314 - protein, 113 aa, Artificial Sequence
  synthetic
DIVMTQSPLSLPVTLGQAASISCRSSQSLLYSDGKIYLSWFHQRPGQPPRRLIYKVSKRDSGVPDRFGGSGSDSDFTLKISRVEAEDVGIYYCMQGTHWPLTFGGGTKVEIKR

SEQ ID NO: 5315 - DNA, 33 bp, Artificial Sequence
  synthetic
caaagcctcctctacagtgatggaaaaatatac

SEQ ID NO: 5316 - protein, 11 aa, Artificial Sequence
  synthetic
QSLLYSDGKIY

SEQ ID NO: 5317 - DNA, 9 bp, Artificial Sequence
  synthetic
aaggtttct

SEQ ID NO: 5318 - protein, 3 aa, Artificial Sequence
  synthetic
KVS

SEQ ID NO: 5319 - DNA, 27 bp, Artificial Sequence
  synthetic
atgcaaggtacacactggccgctcact

SEQ ID NO: 5320 - protein, 9 aa, Artificial Sequence
  synthetic
MQGTHWPLT

SEQ ID NO: 5321 - DNA, 363 bp, Artificial Sequence
  synthetic
gaggtgcagctggtggagtctgggggagacttggtacagcctggggggtccctgagactctcctgtgcagcctctggattcacctttaacagctatgccatgaactgggtccgccaggctccagggaaggggctggagtgggtctcagctgttagtaatactggttctggcacgtactacgcagactccgtgaagggccggttcaccatctccagagacaattccaagaacacgctgtatctgcaaatgaacagcctgcgagccgaggacacggccgtatattactgtgcgaaaggtctgttcgggacctactacgccctctttgactactggggccagggaaccacggtcaccgtctcctca

SEQ ID NO: 5322 - protein, 121 aa, Artificial Sequence
  synthetic
EVQLVESGGDLVQPGGSLRLSCAASGFTFNSYAMNWVRQAPGKGLEWVSAVSNTGSGTYYADSVKGRFTISRDNSKNTLYLQMNSLRAEDTAVYYCAKGLFGTYYALFDYWGQGTTVTVSS

SEQ ID NO: 5323 - DNA, 24 bp, Artificial Sequence
  synthetic
ggattcacctttaacagctatgcc

SEQ ID NO: 5324 - protein, 8 aa, Artificial Sequence
  synthetic
GFTFNSYA

SEQ ID NO: 5325 - DNA, 24 bp, Artificial Sequence
  synthetic
gttagtaatactggttctggcacg

SEQ ID NO: 5326 - protein, 8 aa, Artificial Sequence
  synthetic
VSNTGSGT

SEQ ID NO: 5327 - DNA, 42 bp, Artificial Sequence; identical to SEQ ID NO: 5215
  synthetic

SEQ ID NO: 5328 - protein, 14 aa, Artificial Sequence
  synthetic
AKGLFGTYYALFDY

SEQ ID NO: 5329 - DNA, 324 bp, Artificial Sequence
  synthetic
gacatcctgatgacccagtctccatcttccgtgtctgcatctgttggagacagagtcaccatcacttgtcgggcgagtcaggatattagcagttggttagcctggtatcagcagaaaccagggaaagcccctaagctcctgatctatgttgcatccaatttgcaaagtggggtcccatcaaggttcagcggcagtggatctgggacagatttcactctctccatcaacagcctgcagcctgaagattttgcaacttacttttgtcaacaggctaacagtttcccgatcaccttcggccaagggaccaaactggagatcaaacga

SEQ ID NO: 5330 - protein, 108 aa, Artificial Sequence
  synthetic
DILMTQSPSSVSASVGDRVTITCRASQDISSWLAWYQQKPGKAPKLLIYVASNLQSGVPSRFSGSGSGTDFTLSINSLQPEDFATYFCQQANSFPITFGQGTKLEIKR

SEQ ID NO: 5331 - DNA, 18 bp, Artificial Sequence
  synthetic
caggatattagcagttgg

SEQ ID NO: 5332 - protein, 6 aa, Artificial Sequence
  synthetic
QDISSW

SEQ ID NO: 5333 - DNA, 9 bp, Artificial Sequence
  synthetic
gttgcatcc

SEQ ID NO: 5334 - protein, 3 aa, Artificial Sequence
  synthetic
VAS

SEQ ID NO: 5335 - DNA, 27 bp, Artificial Sequence
  synthetic
caacaggctaacagtttcccgatcacc

SEQ ID NO: 5336 - protein, 9 aa, Artificial Sequence
  synthetic
QQANSFPIT

SEQ ID NO: 5337 - DNA, 366 bp, Artificial Sequence
  synthetic
gaggtgcagctggtggagtctggagcagaggtgaaaaagcccggggagtctctgaagatctcctgtaagggttctggatacagttttatcacttattggatcggctgggtgcgccagatgcccgggaaaggcctggagtggatgggaatcatctatcctggtgactctgataccagatacagcccgtccttccaaggccaggtcaccatgtcagccgacaagtccatcaataccgcctaccttcagtggagtagtctgaaggcctcggacaccgccatttattactgtgcgagactcgaaaaaataactttaaaggggggcggtatggacgtctgggcccaagggaccacggtcaccgtctcctca

SEQ ID NO: 5338 - protein, 122 aa, Artificial Sequence
  synthetic
EVQLVESGAEVKKPGESLKISCKGSGYSFITYWIGWVRQMPGKGLEWMGIIYPGDSDTRYSPSFQGQVTMSADKSINTAYLQWSSLKASDTAIYYCARLEKITLKGGGMDVWAQGTTVTVSS

SEQ ID NO: 5339 - DNA, 24 bp, Artificial Sequence
  synthetic
ggatacagttttatcacttattgg

SEQ ID NO: 5340 - protein, 8 aa, Artificial Sequence
  synthetic
GYSFITYW

SEQ ID NO: 5341 - DNA, 24 bp, Artificial Sequence
  synthetic
atctatcctggtgactctgatacc

SEQ ID NO: 5342 - protein, 8 aa, Artificial Sequence
  synthetic
IYPGDSDT

SEQ ID NO: 5343 - DNA, 45 bp, Artificial Sequence; identical to SEQ ID NO: 5167
  synthetic

SEQ ID NO: 5344 - protein, 15 aa, Artificial Sequence
  synthetic
ARLEKITLKGGGMDV

SEQ ID NO: 5345 - DNA, 324 bp, Artificial Sequence
  synthetic
gacatcctgatgacccagtctccatcctccctgtctgcatctgtaggagacagagtcaccatcacttgccgggcaagtcagaccattagcaggtatttaaattggtatcagcataaaccagggaaagcccctaaactcctgatctatactgcatcaagtttacaaagtggggtcccatcaaggttcagtggcagtggatctgggacagatttcactctcaccatcagcagtctgcaacctgaagattttgcaacttactattgtcaacagagttacaatatcccgtacacttttggccaggggaccaaggtggagatcaaacga

SEQ ID NO: 5346 - protein, 108 aa, Artificial Sequence
  synthetic
DILMTQSPSSLSASVGDRVTITCRASQTISRYLNWYQHKPGKAPKLLIYTASSLQSGVPSRFSGSGSGTDFTLTISSLQPEDFATYYCQQSYNIPYTFGQGTKVEIKR

SEQ ID NO: 5347 - DNA, 18 bp, Artificial Sequence
  synthetic
cagaccattagcaggtat

SEQ ID NO: 5348 - protein, 6 aa, Artificial Sequence
  synthetic
QTISRY

SEQ ID NO: 5349 - DNA, 9 bp, Artificial Sequence
  synthetic
actgcatca

SEQ ID NO: 5350 - protein, 3 aa, Artificial Sequence
  synthetic
TAS

SEQ ID NO: 5351 - DNA, 27 bp, Artificial Sequence
  synthetic
caacagagttacaatatcccgtacact

SEQ ID NO: 5352 - protein, 9 aa, Artificial Sequence
  synthetic
QQSYNIPYT

SEQ ID NO: 5353 - DNA, 354 bp, Artificial Sequence
  synthetic
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtggcggtagtaccacatactacgcagactccgtgaagggccggttcaccatctccagagacaattccaagaacacgctgtatctgcaaatgaacagcctgagagccgaggacacggccgtatatttctgtgcgattagaggatacaactatggtcctgactactggggccagggaaccctggtcaccgtctcctca

SEQ ID NO: 5354 - protein, 118 aa, Artificial Sequence
  synthetic
EVQLVESGGGLVQPGGSLRLSCAASGFTFSSYAMSWVRQAPGKGLEWVSAISGGGSTTYYADSVKGRFTISRDNSKNTLYLQMNSLRAEDTAVYFCAIRGYNYGPDYWGQGTLVTVSS

SEQ ID NO: 5355 - DNA, 24 bp, Artificial Sequence
  synthetic
ggattcacctttagcagctatgcc

SEQ ID NO: 5356 - protein, 8 aa, Artificial Sequence
  synthetic
GFTFSSYA

SEQ ID NO: 5357 - DNA, 24 bp, Artificial Sequence
  synthetic
attagtggtggcggtagtaccaca

SEQ ID NO: 5358 - protein, 8 aa, Artificial Sequence
  synthetic
ISGGGSTT

SEQ ID NO: 5359 - DNA, 33 bp, Artificial Sequence
  synthetic
gcgattagaggatacaactatggtcctgactac

SEQ ID NO: 5360 - protein, 11 aa, Artificial Sequence
  synthetic
AIRGYNYGPDY

SEQ ID NO: 5361 - DNA, 327 bp, Artificial Sequence
  synthetic
gacatccagatgacccagtctccatcctccctgtctgcatctgtaggagacagagtcaccatcacttgccgggcaagtcagggcattagaaatgatttagtctggtatcagcagaaaccagggaaagcccctaagctcctgatctatgctgcatccagtttacaaagtggggtcccgtcaaggttcagcggcactggatctggcacagatttcactctcaccatcagcagcctgcagcctgaagattttgcaacttattactgtctacaagattacaattaccccacgtggacgttcggccaagggaccaaggtggagatcaaacga

SEQ ID NO: 5362 - protein, 109 aa, Artificial Sequence
  synthetic
DIQMTQSPSSLSASVGDRVTITCRASQGIRNDLVWYQQKPGKAPKLLIYAASSLQSGVPSRFSGTGSGTDFTLTISSLQPEDFATYYCLQDYNYPTWTFGQGTKVEIKR

SEQ ID NO: 5363 - DNA, 18 bp, Artificial Sequence
  synthetic
cagggcattagaaatgat

SEQ ID NO: 5364 - protein, 6 aa, Artificial Sequence
  synthetic
QGIRND

SEQ ID NO: 5365 - DNA, 9 bp, Artificial Sequence
  synthetic
gctgcatcc

SEQ ID NO: 5366 - protein, 3 aa, Artificial Sequence
  synthetic
AAS

SEQ ID NO: 5367 - DNA, 30 bp, Artificial Sequence
  synthetic
ctacaagattacaattaccccacgtggacg

SEQ ID NO: 5368 - protein, 10 aa, Artificial Sequence
  synthetic
LQDYNYPTWT

SEQ ID NO: 5369 - DNA, 363 bp, Artificial Sequence
  synthetic
gaggtgcagctggtggagtctgggggagacttggtacagcctggggggtccctgagactctcctgtgcagcctctggattcacctttaacagctatgccatgaactgggtccgccaggctccagggaaggggctggagtgggtctcagctattagtggtagtggtggtagcacatactacgcagactccgtgaagggccggttcaccatctccagagacaattccaagaacacgctgtatctacaaatgaacagcctgagagccgaggacacggccgtatattactgtgcgaaaggtctgttcgggacctactacgccctctttgactactggggccagggaaccctggtcaccgtctcctca

SEQ ID NO: 5370 - protein, 121 aa, Artificial Sequence
  synthetic
EVQLVESGGDLVQPGGSLRLSCAASGFTFNSYAMNWVRQAPGKGLEWVSAISGSGGSTYYADSVKGRFTISRDNSKNTLYLQMNSLRAEDTAVYYCAKGLFGTYYALFDYWGQGTLVTVSS

SEQ ID NO: 5371 - DNA, 24 bp, Artificial Sequence
  synthetic
ggattcacctttaacagctatgcc

SEQ ID NO: 5372 - protein, 8 aa, Artificial Sequence
  synthetic
GFTFNSYA

SEQ ID NO: 5373 - DNA, 24 bp, Artificial Sequence
  synthetic
attagtggtagtggtggtagcaca

SEQ ID NO: 5374 - protein, 8 aa, Artificial Sequence
  synthetic
ISGSGGST

SEQ ID NO: 5375 - DNA, 42 bp, Artificial Sequence; identical to SEQ ID NO: 5215
  synthetic

SEQ ID NO: 5376 - protein, 14 aa, Artificial Sequence
  synthetic
AKGLFGTYYALFDY

SEQ ID NO: 5377 - DNA, 321 bp, Artificial Sequence
  synthetic
gacatcgtgatgacccagtctccatcctccctgtctgcatctgtaggagacagagtcaccatcacttgccgggcaagtcagaacattagcagctatttacattggtatcagcagaaaccagggaaggcccctaaactcctgatctatgctgcatccagtttgcaaagtggggtcccatcaaggttcagtggcagtggatctgggacagatttcactctcaccatcagcagtctgcaacctgaagatttggaaattaatcctgtcaacaaagttacagtattcccctttttcggcggagggaccaaggtggagatcaaacga

SEQ ID NO: 5378 - protein, 107 aa, Artificial Sequence
  synthetic
DIVMTQSPSSLSASVGDRVTITCRASQNISSYLHWYQQKPGKAPKLLIYAASSLQSGVPSRFSGSGSGTDFTLTISSLQPEDLEINPVNKVTVFPFFGGGTKVEIKR

SEQ ID NO: 5379 - DNA, 18 bp, Artificial Sequence
  synthetic
cagaacattagcagctat

SEQ ID NO: 5380 - protein, 6 aa, Artificial Sequence
  synthetic
QNISSY

SEQ ID NO: 5381 - DNA, 9 bp, Artificial Sequence
  synthetic
gctgcatcc

SEQ ID NO: 5382 - protein, 3 aa, Artificial Sequence
  synthetic
AAS

SEQ ID NO: 5383 - DNA, 24 bp, Artificial Sequence
  synthetic
caacaaagttacagtattcccctt

SEQ ID NO: 5384 - protein, 8 aa, Artificial Sequence
  synthetic
QQSYSIPL

SEQ ID NO: 5385 - DNA, 384 bp, Artificial Sequence
  synthetic
gaggtgcagctggtggagtctgggggagggatggtccagccgggggggtccctgagactctcctgtgcagcctctggattcacctttagtagttattggatgagttgggtccgccaggctccagggaaggggctggagtgggtggccaacataaaacaagatggtagtgaagaattctatgtggactctgtgacgggccgattcaccatctccagagacgacgccaagaaatcactgtatctgcaaatgaggagcctgagagccgaggacacggctgtgtattactgtgcgagagagagcccgtatagtagtagttggtatggaccatattactactatggtatggacgtctggggccaagggaccacggtcaccgtctcctca

SEQ ID NO: 5386 - protein, 128 aa, Artificial Sequence
  synthetic
EVQLVESGGGMVQPGGSLRLSCAASGFTFSSYWMSWVRQAPGKGLEWVANIKQDGSEEFYVDSVTGRFTISRDDAKKSLYLQMRSLRAEDTAVYYCARESPYSSSWYGPYYYYGMDVWGQGTTVTVSS

SEQ ID NO: 5387 - DNA, 24 bp, Artificial Sequence
  synthetic
ggattcacctttagtagttattgg

SEQ ID NO: 5388 - protein, 8 aa, Artificial Sequence
  synthetic
GFTFSSYW

SEQ ID NO: 5389 - DNA, 24 bp, Artificial Sequence
  synthetic
ataaaacaagatggtagtgaagaa

SEQ ID NO: 5390 - protein, 8 aa, Artificial Sequence
  synthetic
IKQDGSEE

SEQ ID NO: 5391 - DNA, 63 bp, Artificial Sequence
  synthetic
gcgagagagagcccgtatagtagtagttggtatggaccatattactactatggtatggacgtc

SEQ ID NO: 5392 - protein, 21 aa, Artificial Sequence
  synthetic
ARESPYSSSWYGPYYYYGMDV

SEQ ID NO: 5393 - DNA, 321 bp, Artificial Sequence
  synthetic
gacatcgtgatgacccagtctccagccaccctatctatgtctccaggggaaagagtcaccctctcctgcagggccagtcaaaatattggcatcaacttagtctggtaccagcggaaacctggccaggctcccaggctcctcatctatggtgcatccaccagggccactgggatcccagccaggttcagtggcagtgggtctgggacagagttcactctcaccgtcagcagcctgcagtctgaagattttgcaatttattattgtcagcagtataatgactggcccactttcggcggagggaccaaggtggagatcaaacga

SEQ ID NO: 5394 - protein, 107 aa, Artificial Sequence
  synthetic
DIVMTQSPATLSMSPGERVTLSCRASQNIGINLVWYQRKPGQAPRLLIYGASTRATGIPARFSGSGSGTEFTLTVSSLQSEDFAIYYCQQYNDWPTFGGGTKVEIKR

SEQ ID NO: 5395 - DNA, 18 bp, Artificial Sequence
  synthetic
caaaatattggcatcaac

SEQ ID NO: 5396 - protein, 6 aa, Artificial Sequence
  synthetic
QNIGIN

SEQ ID NO: 5397 - DNA, 9 bp, Artificial Sequence
  synthetic
ggtgcatcc

SEQ ID NO: 5398 - protein, 3 aa, Artificial Sequence
  synthetic
GAS

SEQ ID NO: 5399 - DNA, 24 bp, Artificial Sequence
  synthetic
cagcagtataatgactggcccact

SEQ ID NO: 5400 - protein, 8 aa, Artificial Sequence
  synthetic
QQYNDWPT

SEQ ID NO: 5401 - DNA, 366 bp, Artificial Sequence
  synthetic
gaggtgcagctggtggagtctggagcagaggtgaaaaagcccggggagtctctgaagatctcctgtaagggttctggatacacctttaccaaatactggatcggctgggtgcgccagatgcccgggaaaggcctggagtggatgggaatcatctatcctggtgactctgataccagatatagcccgtccttccagggccaggtcaccatttcagccgacaattccatcaacaccgcctacctacactggagcagcctgaaggcctcggacaccgccatgtattactgtgcgagactcgaaactataactggaaaacagggcggtatggtcgtctggggccaagggaccatggtcaccgtctcctca

SEQ ID NO: 5402 - protein, 122 aa, Artificial Sequence
  synthetic
EVQLVESGAEVKKPGESLKISCKGSGYTFTKYWIGWVRQMPGKGLEWMGIIYPGDSDTRYSPSFQGQVTISADNSINTAYLHWSSLKASDTAMYYCARLETITGKQGGMVVWGQGTMVTVSS

SEQ ID NO: 5403 - DNA, 24 bp, Artificial Sequence
  synthetic
ggatacacctttaccaaatactgg

SEQ ID NO: 5404 - protein, 8 aa, Artificial Sequence
  synthetic
GYTFTKYW

SEQ ID NO: 5405 - DNA, 24 bp, Artificial Sequence
  synthetic
atctatcctggtgactctgatacc

SEQ ID NO: 5406 - protein, 8 aa, Artificial Sequence
  synthetic
IYPGDSDT

SEQ ID NO: 5407 - DNA, 45 bp, Artificial Sequence
  synthetic
gcgagactcgaaactataactggaaaacagggcggtatggtcgtc

SEQ ID NO: 5408 - protein, 15 aa, Artificial Sequence
  synthetic
ARLETITGKQGGMVV

SEQ ID NO: 5409 - DNA, 324 bp, Artificial Sequence
  synthetic
gacatcctgatgacccagtctccatcctccctgtctgcatctgtaggagacagagtcaccatctcttgtcgggcaagtcagagtattagtaggtatttaaattggtatcagcagaaaccagggaaagccccaaacctcctgatctatggtgtatccggttttcaaagtggggtcccattaaggatcagtggcagtggatctgggacagatttcactctcaccatcagcagtctgcaacctgaagattttgcaaattactactgtcaacagagttatagtatcccgtacacttttggccaggggaccaaggtggagatcaaacga

SEQ ID NO: 5410 - protein, 108 aa, Artificial Sequence
  synthetic
DILMTQSPSSLSASVGDRVTISCRASQSISRYLNWYQQKPGKAPNLLIYGVSGFQSGVPLRISGSGSGTDFTLTISSLQPEDFANYYCQQSYSIPYTFGQGTKVEIKR

SEQ ID NO: 5411 - DNA, 18 bp, Artificial Sequence
  synthetic
cagagtattagtaggtat

SEQ ID NO: 5412 - protein, 6 aa, Artificial Sequence
  synthetic
QSISRY

SEQ ID NO: 5413 - DNA, 9 bp, Artificial Sequence
  synthetic
ggtgtatcc

SEQ ID NO: 5414 - protein, 3 aa, Artificial Sequence
  synthetic
GVS

SEQ ID NO: 5415 - DNA, 27 bp, Artificial Sequence
  synthetic
caacagagttatagtatcccgtacact

SEQ ID NO: 5416 - protein, 9 aa, Artificial Sequence
  synthetic
QQSYSIPYT

SEQ ID NO: 5417 - DNA, 354 bp, Artificial Sequence; identical to SEQ ID NO: 5353
  synthetic

SEQ ID NO: 5418 - protein, 118 aa, Artificial Sequence; identical to SEQ ID NO: 5354
  synthetic

SEQ ID NO: 5419 - DNA, 24 bp, Artificial Sequence
  synthetic
ggattcacctttagcagctatgcc

SEQ ID NO: 5420 - protein, 8 aa, Artificial Sequence
  synthetic
GFTFSSYA

SEQ ID NO: 5421 - DNA, 24 bp, Artificial Sequence
  synthetic
attagtggtggcggtagtaccaca

SEQ ID NO: 5422 - protein, 8 aa, Artificial Sequence
  synthetic
ISGGGSTT

SEQ ID NO: 5423 - DNA, 33 bp, Artificial Sequence; identical to SEQ ID NO: 5359
  synthetic

SEQ ID NO: 5424 - protein, 11 aa, Artificial Sequence
  synthetic
AIRGYNYGPDY

SEQ ID NO: 5425 - DNA, 327 bp, Artificial Sequence
  synthetic
gacatcctgatgacccagtctccatcctccctgtctgcatctgtaggagacagagtcaccatcacttgccgggcaagtcagggcattagaaatgatttagtctggtatcagcagaaaccagggaaagcccctaagctcctgatctatgctgcatccagtttacaaagtggggtcccgtcaaggttcagcggcactggatctggcacagatttcactctcaccatcagcagcctgcagcctgaagattttgcaacttattactgtctacaagattacaattaccccacgtggacgttcggccaagggaccaaggtggagatcaaacga

SEQ ID NO: 5426 - protein, 109 aa, Artificial Sequence
  synthetic
DILMTQSPSSLSASVGDRVTITCRASQGIRNDLVWYQQKPGKAPKLLIYAASSLQSGVPSRFSGTGSGTDFTLTISSLQPEDFATYYCLQDYNYPTWTFGQGTKVEIKR

SEQ ID NO: 5427 - DNA, 18 bp, Artificial Sequence
  synthetic
cagggcattagaaatgat

SEQ ID NO: 5428 - protein, 6 aa, Artificial Sequence
  synthetic
QGIRND

SEQ ID NO: 5429 - DNA, 9 bp, Artificial Sequence
  synthetic
gctgcatcc

SEQ ID NO: 5430 - protein, 3 aa, Artificial Sequence
  synthetic
AAS

SEQ ID NO: 5431 - DNA, 30 bp, Artificial Sequence; identical to SEQ ID NO: 5367
  synthetic

SEQ ID NO: 5432 - protein, 10 aa, Artificial Sequence
  synthetic
LQDYNYPTWT

SEQ ID NO: 5433 - DNA, 366 bp, Artificial Sequence
  synthetic
caggtgcagctggtgcagtggggcgcaggactgttgaagccttcggagaccctgtccctcacctgcgctgtctatggtgggtccttcagtacttactattggagctggatccgccagcccccagggaaggggctggagtggattggggaaatcaatcatactggaagcaccaactacaacccgtccctcaagagtcgagtcaccatatcagtagacacgtccaagaaccagttctccctgaagctgaactctgtgaccgccgcggacacgtctgtatattactgtgcgagaggccctagtacattaactacagactactacggtttggacgtctggggccaagggaccatggtcaccgtctcctca

SEQ ID NO: 5434 - protein, 122 aa, Artificial Sequence
  synthetic
QVQLVQWGAGLLKPSETLSLTCAVYGGSFSTYYWSWIRQPPGKGLEWIGEINHTGSTNYNPSLKSRVTISVDTSKNQFSLKLNSVTAADTSVYYCARGPSTLTTDYYGLDVWGQGTMVTVSS

SEQ ID NO: 5435 - DNA, 24 bp, Artificial Sequence
  synthetic
ggtgggtccttcagtacttactat

SEQ ID NO: 5436 - protein, 8 aa, Artificial Sequence
  synthetic
GGSFSTYY

SEQ ID NO: 5437 - DNA, 21 bp, Artificial Sequence
  synthetic
atcaatcatactggaagcacc

SEQ ID NO: 5438 - protein, 7 aa, Artificial Sequence
  synthetic
INHTGST

SEQ ID NO: 5439 - DNA, 48 bp, Artificial Sequence
  synthetic
gcgagaggccctagtacattaactacagactactacggtttggacgtc

SEQ ID NO: 5440 - protein, 16 aa, Artificial Sequence
  synthetic
ARGPSTLTTDYYGLDV

SEQ ID NO: 5441 - DNA, 324 bp, Artificial Sequence; identical to SEQ ID NO: 3313
  synthetic

SEQ ID NO: 5442 - protein, 108 aa, Artificial Sequence; identical to SEQ ID NO: 3314
  synthetic

SEQ ID NO: 5443 - DNA, 18 bp, Artificial Sequence
  synthetic
caggacattagcaactat

SEQ ID NO: 5444 - protein, 6 aa, Artificial Sequence
  synthetic
QDISNY

SEQ ID NO: 5445 - DNA, 9 bp, Artificial Sequence
  synthetic
gatgcatcc

SEQ ID NO: 5446 - protein, 3 aa, Artificial Sequence
  synthetic
DAS

SEQ ID NO: 5447 - DNA, 27 bp, Artificial Sequence
  synthetic
caacagtatgataatctcccgctcact

SEQ ID NO: 5448 - protein, 9 aa, Artificial Sequence
  synthetic
QQYDNLPLT

SEQ ID NO: 5449 - DNA, 375 bp, Artificial Sequence
  synthetic
gaggtgcagctggtggagtctgggggaggtgtggtacggcctggggggtccctgagactctcctgtgcagcctctggattcacctttgatgattatgccatgacttgggtccgccaagctccagggaaggggctggagtgggtctctggtattaattggagtggtgatagaataggatatgcagactctgtgaggggccgattcaccatctccagagacaacgccaagaactccctatttctgcaaatgaacagtctgagagccgaggacacggccttgtatcactgtgcgagagatagggatggaggtcctccttcctacttctactacggtatggacgtctggggccaagggaccacggtcaccgtctcctca

SEQ ID NO: 5450 - protein, 125 aa, Artificial Sequence
  synthetic
EVQLVESGGGVVRPGGSLRLSCAASGFTFDDYAMTWVRQAPGKGLEWVSGINWSGDRIGYADSVRGRFTISRDNAKNSLFLQMNSLRAEDTALYHCARDRDGGPPSYFYYGMDVWGQGTTVTVSS

SEQ ID NO: 5451 - DNA, 24 bp, Artificial Sequence
  synthetic
ggattcacctttgatgattatgcc

SEQ ID NO: 5452 - protein, 8 aa, Artificial Sequence
  synthetic
GFTFDDYA

SEQ ID NO: 5453 - DNA, 24 bp, Artificial Sequence
  synthetic
attaattggagtggtgatagaata

SEQ ID NO: 5454 - protein, 8 aa, Artificial Sequence
  synthetic
INWSGDRI

SEQ ID NO: 5455 - DNA, 54 bp, Artificial Sequence
  synthetic
gcgagagatagggatggaggtcctccttcctacttctactacggtatggacgtc

SEQ ID NO: 5456 - protein, 18 aa, Artificial Sequence
  synthetic
ARDRDGGPPSYFYYGMDV

SEQ ID NO: 5457 - DNA, 324 bp, Artificial Sequence
  synthetic
gacatcctgatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgtacacttttggccaggggaccaaggtggagatcaaacga

SEQ ID NO: 5458 - protein, 108 aa, Artificial Sequence
  synthetic
DILMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKVEIKR

SEQ ID NO: 5459 - DNA, 18 bp, Artificial Sequence
  synthetic
caggacattagcaactat

SEQ ID NO: 5460 - protein, 6 aa, Artificial Sequence
  synthetic
QDISNY

SEQ ID NO: 5461 - DNA, 9 bp, Artificial Sequence
  synthetic
gatgcatcc

SEQ ID NO: 5462 - protein, 3 aa, Artificial Sequence
  synthetic
DAS

SEQ ID NO: 5463 - DNA, 27 bp, Artificial Sequence
  synthetic
caacagtatgataatctcccgtacact

SEQ ID NO: 5464 - protein, 9 aa, Artificial Sequence
  synthetic
QQYDNLPYT

SEQ ID NO: 5465 - DNA, 363 bp, Artificial Sequence
  synthetic
gaggtgcagctggtgcagtggggcgcaggactgttgaagccttcggagaccctgtccctcacctgcgctgtctatggtgggtccttcaattattactactggacctggatccgccagcccccagggaaggggctggagtggattggggaaatcactcatagtggaatcaccaacaaaaacccgtccctcaagagtcgagtcactatatcagtagacacgtccaagaaccagttgtccctgaaactgaactctgtgaccgccgcggacacggctgtttattactgtgcgagaggaaagattgaagcagctgtctctgattcttttgatatatggggccaagggacaatggtcaccgtctcttca

SEQ ID NO: 5466 - protein, 121 aa, Artificial Sequence
  synthetic
EVQLVQWGAGLLKPSETLSLTCAVYGGSFNYYYWTWIRQPPGKGLEWIGEITHSGITNKNPSLKSRVTISVDTSKNQLSLKLNSVTAADTAVYYCARGKIEAAVSDSFDIWGQGTMVTVSS

SEQ ID NO: 5467 - DNA, 24 bp, Artificial Sequence
  synthetic
ggtgggtccttcaattattactac

SEQ ID NO: 5468 - protein, 8 aa, Artificial Sequence
  synthetic
GGSFNYYY

SEQ ID NO: 5469 - DNA, 21 bp, Artificial Sequence
  synthetic
atcactcatagtggaatcacc

SEQ ID NO: 5470 - protein, 7 aa, Artificial Sequence
  synthetic
ITHSGIT

SEQ ID NO: 5471 - DNA, 45 bp, Artificial Sequence
  synthetic
gcgagaggaaagattgaagcagctgtctctgattcttttgatata

SEQ ID NO: 5472 - protein, 15 aa, Artificial Sequence
  synthetic
ARGKIEAAVSDSFDI

SEQ ID NO: 5473 - DNA, 324 bp, Artificial Sequence
  synthetic
gacatcgtgatgacccagtctccaggcaccctgtctttgtctccaggggaaagagccaccctctcctgtagggtcagtcagagtgttagcagtagttactcagcctggtaccagcagaaacctggccaggctcccagactcctcatctatggtgcatccagcagggccgctggcatcccagacaggttcagtggcagtgggtctgggacagacttcactctcaccatcagcagactggagcctgaagattttgctgtgtattactgtcagcagtttggtgactcattcactttcggccctgggaccaaggtggagatcaaacga

SEQ ID NO: 5474 - protein, 108 aa, Artificial Sequence
  synthetic
DIVMTQSPGTLSLSPGERATLSCRVSQSVSSSYSAWYQQKPGQAPRLLIYGASSRAAGIPDRFSGSGSGTDFTLTISRLEPEDFAVYYCQQFGDSFTFGPGTKVEIKR

SEQ ID NO: 5475 - DNA, 21 bp, Artificial Sequence
  synthetic
cagagtgttagcagtagttac

SEQ ID NO: 5476 - protein, 7 aa, Artificial Sequence
  synthetic
QSVSSSY

SEQ ID NO: 5477 - DNA, 9 bp, Artificial Sequence
  synthetic
ggtgcatcc

SEQ ID NO: 5478 - protein, 3 aa, Artificial Sequence
  synthetic
GAS

SEQ ID NO: 5479 - DNA, 24 bp, Artificial Sequence
  synthetic
cagcagtttggtgactcattcact

SEQ ID NO: 5480 - protein, 8 aa, Artificial Sequence
  synthetic
QQFGDSFT

SEQ ID NO: 5481 - DNA, 366 bp, Artificial Sequence
  synthetic
caggtgcagctggtggagtctgggggaggcttggtacaggctggggggtccctgagactctcctgtgcagcctctggattcccctttagaagttatgccatgacctgggtccgccaggctccagggaaggggctggagtgggtctcagctattagtactagtggtggtagcacatattacgcagactccgtgaagggccggttcaccatctccagagacaattccaagaacacgctgtatctgcagatgaacagcctgagagtcgatgacacggccgtttattactgtgcgaaagatctgggggccctcggctactactatggtattgacgtctggggccaggggaccacggtcaccgtctcctca

SEQ ID NO: 5482 - protein, 122 aa, Artificial Sequence
  synthetic
QVQLVESGGGLVQAGGSLRLSCAASGFPFRSYAMTWVRQAPGKGLEWVSAISTSGGSTYYADSVKGRFTISRDNSKNTLYLQMNSLRVDDTAVYYCAKDLGALGYYYGIDVWGQGTTVTVSS

SEQ ID NO: 5483 - DNA, 24 bp, Artificial Sequence
  synthetic
ggattcccctttagaagttatgcc

SEQ ID NO: 5484 - protein, 8 aa, Artificial Sequence
  synthetic
GFPFRSYA

SEQ ID NO: 5485 - DNA, 24 bp, Artificial Sequence
  synthetic
attagtactagtggtggtagcaca

SEQ ID NO: 5486 - protein, 8 aa, Artificial Sequence
  synthetic
ISTSGGST

SEQ ID NO: 5487 - DNA, 45 bp, Artificial Sequence
  synthetic
gcgaaagatctgggggccctcggctactactatggtattgacgtc

SEQ ID NO: 5488 - protein, 15 aa, Artificial Sequence
  synthetic
AKDLGALGYYYGIDV

SEQ ID NO: 5489 - DNA, 324 bp, Artificial Sequence
  synthetic
gacatcgtgatgacccagtctccagccaccctgtctttgtctccaggggaaggagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggtcagacttcactctcaccatcagcagccttgagcctgaggattttgcagtttattcttgtcagcagcgtagcaactggccgtggacgttcggccaagggaccaaggtggagatcaaacga

SEQ ID NO: 5490 - protein, 108 aa, Artificial Sequence
  synthetic
DIVMTQSPATLSLSPGEGATLSCRASQSVSNYLAWYQQKPGQAPRLLIYDASNRATGIPARFSGSGSGSDFTLTISSLEPEDFAVYSCQQRSNWPWTFGQGTKVEIKR

SEQ ID NO: 5491 - DNA, 18 bp, Artificial Sequence
  synthetic
cagagtgttagcaactac

SEQ ID NO: 5492 - protein, 6 aa, Artificial Sequence
  synthetic
QSVSNY

SEQ ID NO: 5493 - DNA, 9 bp, Artificial Sequence
  synthetic
gatgcatcc

SEQ ID NO: 5494 - protein, 3 aa, Artificial Sequence
  synthetic
DAS

SEQ ID NO: 5495 - DNA, 27 bp, Artificial Sequence
  synthetic
cagcagcgtagcaactggccgtggacg

SEQ ID NO: 5496 - protein, 9 aa, Artificial Sequence
  synthetic
QQRSNWPWT

SEQ ID NO: 5497 - DNA, 366 bp, Artificial Sequence
  synthetic
gaggtgcagctggtggagtcgggcccaggactggtgaagccttcggagaccctgtccctcacctgcactgtctctggtggctccatcagtagttactactggagctggatccggcagcccccagggaagggactggagtggattgcgtatatctataacagtgggagaatcaagtacaacccctccctcaagagtcgagtcaccatatcaggagacacgtccaagaaccagttctccctgaagttgacctctgtgaccgctgcggacacggccgtgtattactgtgcgagagatcgcctgtatagcagcagcccccactggtacttcgatctctggggccgtggcaccatggtcaccgtctcctca

SEQ ID NO: 5498 - protein, 122 aa, Artificial Sequence
  synthetic
EVQLVESGPGLVKPSETLSLTCTVSGGSISSYYWSWIRQPPGKGLEWIAYIYNSGRIKYNPSLKSRVTISGDTSKNQFSLKLTSVTAADTAVYYCARDRLYSSSPHWYFDLWGRGTMVTVSS

SEQ ID NO: 5499 - DNA, 24 bp, Artificial Sequence
  synthetic
ggtggctccatcagtagttactac

SEQ ID NO: 5500 - protein, 8 aa, Artificial Sequence
  synthetic
GGSISSYY

SEQ ID NO: 5501 - DNA, 21 bp, Artificial Sequence
  synthetic
atctataacagtgggagaatc

SEQ ID NO: 5502 - protein, 7 aa, Artificial Sequence
  synthetic
IYNSGRI

SEQ ID NO: 5503 - DNA, 48 bp, Artificial Sequence
  synthetic
gcgagagatcgcctgtatagcagcagcccccactggtacttcgatctc

SEQ ID NO: 5504 - protein, 16 aa, Artificial Sequence
  synthetic
ARDRLYSSSPHWYFDL

SEQ ID NO: 5505 - DNA, 324 bp, Artificial Sequence
  synthetic
gacatcctgatgacccagtctccatcctccctgtctgcatctttaggagacagagtcagtatcacttgccgggccagtcagagcattagcacctatttaaattggtatcagcagaaaccagggaaagcccctaatatcctgatctctgctgcatccagtttgcaaagtggggtcccatcacggttcagtggcagtggatctgggacagatttcactctcaccatcagcagtctgcaacctgaagattttgcaacttactactgtcaacagagttacgataccccgatcaccttcggccaagggacacgactggagattaaacga

SEQ ID NO: 5506 - protein, 108 aa, Artificial Sequence
  synthetic
DILMTQSPSSLSASLGDRVSITCRASQSISTYLNWYQQKPGKAPNILISAASSLQSGVPSRFSGSGSGTDFTLTISSLQPEDFATYYCQQSYDTPITFGQGTRLEIKR

SEQ ID NO: 5507 - DNA, 18 bp, Artificial Sequence
  synthetic
cagagcattagcacctat

SEQ ID NO: 5508 - protein, 6 aa, Artificial Sequence
  synthetic
QSISTY

SEQ ID NO: 5509 - DNA, 9 bp, Artificial Sequence
  synthetic
gctgcatcc

SEQ ID NO: 5510 - protein, 3 aa, Artificial Sequence
  synthetic
AAS

SEQ ID NO: 5511 - DNA, 27 bp, Artificial Sequence
  synthetic
caacagagttacgataccccgatcacc

SEQ ID NO: 5512 - protein, 9 aa, Artificial Sequence
  synthetic
QQSYDTPIT

SEQ ID NO: 5513 - DNA, 375 bp, Artificial Sequence
  synthetic
caggtgcagctggtggagtctgggggaggtgtggtccggcctggggggtccctaagactctcctgtgcagcctctggattcatctttgatgattatgccatgatctgggtccgccaagttccagggaaggggctgcagtgggtctctggtattaattggaatggtggtaatataggttatgtagactttgtgaagggccgattcaccatctccagagacaacgccaagaactccctgtatctgcaaatgaacagtctgagagtcgaggacacggccttgtattattgtgcgagagatagggatggaggtcctccttccttttactactacggtatggacgtctggggccaagggaccacggtcaccgtctcctca

SEQ ID NO: 5514 - protein, 125 aa, Artificial Sequence
  synthetic
QVQLVESGGGVVRPGGSLRLSCAASGFIFDDYAMIWVRQVPGKGLQWVSGINWNGGNIGYVDFVKGRFTISRDNAKNSLYLQMNSLRVEDTALYYCARDRDGGPPSFYYYGMDVWGQGTTVTVSS

SEQ ID NO: 5515 - DNA, 24 bp, Artificial Sequence
  synthetic
ggattcatctttgatgattatgcc

SEQ ID NO: 5516 - protein, 8 aa, Artificial Sequence
  synthetic
GFIFDDYA

SEQ ID NO: 5517 - DNA, 24 bp, Artificial Sequence
  synthetic
attaattggaatggtggtaatata

SEQ ID NO: 5518 - protein, 8 aa, Artificial Sequence
  synthetic
INWNGGNI

SEQ ID NO: 5519 - DNA, 54 bp, Artificial Sequence
  synthetic
gcgagagatagggatggaggtcctccttccttttactactacggtatggacgtc

SEQ ID NO: 5520 - protein, 18 aa, Artificial Sequence
  synthetic
ARDRDGGPPSFYYYGMDV

SEQ ID NO: 5521 - DNA, 324 bp, Artificial Sequence
  synthetic
gacatcgtgatgacccagtctccagccaccctgtctttgtctccaggggaaagagccaccctctcctgcagggccagtcagactattagcgactacttagcctggtaccagcagaaacctggccaggctcccaggctcctcatctatgattcatccaacagggccactggcatcccagccaggttcagtggcagtgggtctgggacagactttactctcaccatcaccagcctagagcctgaagattttgtagtttattactgtcagcagcgtagcacctggccgctcactttcggcggagggaccaaggtggagatcaaacga

SEQ ID NO: 5522 - protein, 108 aa, Artificial Sequence
  synthetic
DIVMTQSPATLSLSPGERATLSCRASQTISDYLAWYQQKPGQAPRLLIYDSSNRATGIPARFSGSGSGTDFTLTITSLEPEDFVVYYCQQRSTWPLTFGGGTKVEIKR

SEQ ID NO: 5523 - DNA, 18 bp, Artificial Sequence
  synthetic
cagactattagcgactac

SEQ ID NO: 5524 - protein, 6 aa, Artificial Sequence
  synthetic
QTISDY

SEQ ID NO: 5525 - DNA, 9 bp, Artificial Sequence
  synthetic
gattcatcc

SEQ ID NO: 5526 - protein, 3 aa, Artificial Sequence
  synthetic
DSS

SEQ ID NO: 5527 - DNA, 27 bp, Artificial Sequence
  synthetic
cagcagcgtagcacctggccgctcact

SEQ ID NO: 5528 - protein, 9 aa, Artificial Sequence
  synthetic
QQRSTWPLT

SEQ ID NO: 5529 - DNA, 375 bp, Artificial Sequence
  synthetic
gaggtgcagctggtggagtctgggggaggtgtggtacggcctggggggtccctgagactctcctgtgtagcctctggattcacctttgatgattatgccatgagctgggtccgccaaggtatagggaagggactggagtgggtctctggtattaattggaatggtgatagcacaggttatgcagactctgtgaggggccgattcaccatctccagagacaacgccaagaactccctgtatctgcaaatgaacagtctgagagccgaggacacggccttgtattattgtgcgagagatagggatggaggtcctccttcatattactattttgggatggacgtctggggccaagggaccacggtcaccgtctcctca

SEQ ID NO: 5530 - protein, 125 aa, Artificial Sequence
  synthetic
EVQLVESGGGVVRPGGSLRLSCVASGFTFDDYAMSWVRQGIGKGLEWVSGINWNGDSTGYADSVRGRFTISRDNAKNSLYLQMNSLRAEDTALYYCARDRDGGPPSYYYFGMDVWGQGTTVTVSS

SEQ ID NO: 5531 - DNA, 24 bp, Artificial Sequence
  synthetic
ggattcacctttgatgattatgcc

SEQ ID NO: 5532 - protein, 8 aa, Artificial Sequence
  synthetic
GFTFDDYA

SEQ ID NO: 5533 - DNA, 24 bp, Artificial Sequence
  synthetic
attaattggaatggtgatagcaca

SEQ ID NO: 5534 - protein, 8 aa, Artificial Sequence
  synthetic
INWNGDST

SEQ ID NO: 5535 - DNA, 54 bp, Artificial Sequence
  synthetic
gcgagagatagggatggaggtcctccttcatattactattttgggatggacgtc

SEQ ID NO: 5536 - protein, 18 aa, Artificial Sequence
  synthetic
ARDRDGGPPSYYYFGMDV

SEQ ID NO: 5537 - DNA, 324 bp, Artificial Sequence
  synthetic
gacatcgtgatgacccagtctccagccaccctgtctttgtctccaggggaaagagccaccctctcctgcagggccagtcagaatattaacgactacttagcctggtaccaacagaaacctggccaggctcccaggctcctcatctatgatgcatccaacagggccactggcatcccagccaggttcagtggcagtatgtctgggacagacttcactctcaccatcagtagcctagagactgaagattttgcagtttattactgtcagcagcgtagcaatcggccgctcactttcggcggagggaccaaggtggagatcaaacga

SEQ ID NO: 5538 - protein, 108 aa, Artificial Sequence
  synthetic
DIVMTQSPATLSLSPGERATLSCRASQNINDYLAWYQQKPGQAPRLLIYDASNRATGIPARFSGSMSGTDFTLTISSLETEDFAVYYCQQRSNRPLTFGGGTKVEIKR

SEQ ID NO: 5539 - DNA, 18 bp, Artificial Sequence
  synthetic
cagaatattaacgactac

SEQ ID NO: 5540 - protein, 6 aa, Artificial Sequence
  synthetic
QNINDY

SEQ ID NO: 5541 - DNA, 9 bp, Artificial Sequence
  synthetic
gatgcatcc

SEQ ID NO: 5542 - protein, 3 aa, Artificial Sequence
  synthetic
DAS

SEQ ID NO: 5543 - DNA, 27 bp, Artificial Sequence
  synthetic
cagcagcgtagcaatcggccgctcact

SEQ ID NO: 5544 - protein, 9 aa, Artificial Sequence
  synthetic
QQRSNRPLT

SEQ ID NO: 5545 - DNA, 363 bp, Artificial Sequence
  synthetic
caggtgcagctggtgcagtggggcgcaggactgttgaagccttcggagaccctctccctcacctgtgctgtctatggtgggtccttcagttcttcctactggaactggatccgccagtccccagggaggggactggagtggattggggaaatctttcatagtggaaacaccaactacaacccgtccctcaagagtcgagtcaccatatcagtagacacgtccaagaaccacttctccctgaaactgagctctgtgaccgccgcggacacggctgtgtattactgtgcgagaggaaagatagaatcggctgtttctgattcttttgatatctggggccaagggacaatggtcaccgtctcctca

SEQ ID NO: 5546 - protein, 121 aa, Artificial Sequence
  synthetic
QVQLVQWGAGLLKPSETLSLTCAVYGGSFSSSYWNWIRQSPGRGLEWIGEIFHSGNTNYNPSLKSRVTISVDTSKNHFSLKLSSVTAADTAVYYCARGKIESAVSDSFDIWGQGTMVTVSS

SEQ ID NO: 5547 - DNA, 24 bp, Artificial Sequence
  synthetic
ggtgggtccttcagttcttcctac

SEQ ID NO: 5548 - protein, 8 aa, Artificial Sequence
  synthetic
GGSFSSSY

SEQ ID NO: 5549 - DNA, 21 bp, Artificial Sequence
  synthetic
atctttcatagtggaaacacc

SEQ ID NO: 5550 - protein, 7 aa, Artificial Sequence
  synthetic
IFHSGNT

SEQ ID NO: 5551 - DNA, 45 bp, Artificial Sequence
  synthetic
gcgagaggaaagatagaatcggctgtttctgattcttttgatatc

SEQ ID NO: 5552 - protein, 15 aa, Artificial Sequence
  synthetic
ARGKIESAVSDSFDI

SEQ ID NO: 5553 - DNA, 324 bp, Artificial Sequence
  synthetic
gacatcgtgatgacccagtctccaggcaccctgtctttgtctccaggggaaagagccaccctctcctgcagggccagtcagagtgttagcagcagctacttagcctggtaccagcagaaacctggccaggctcccaggctcctcatctatggtacatccagcagggccactggcatcccagacaggttcagtggcagtgggtctgggacagacttcactctcaccatcagcagactggagcctgaagactttgcagtgtatttctgtcagcagtatggaagctcattcattttcggccctgggaccaaggtggagatcaaacga

SEQ ID NO: 5554 - protein, 108 aa, Artificial Sequence
  synthetic
DIVMTQSPGTLSLSPGERATLSCRASQSVSSSYLAWYQQKPGQAPRLLIYGTSSRATGIPDRFSGSGSGTDFTLTISRLEPEDFAVYFCQQYGSSFIFGPGTKVEIKR

SEQ ID NO: 5555 - DNA, 21 bp, Artificial Sequence
  synthetic
cagagtgttagcagcagctac

SEQ ID NO: 5556 - protein, 7 aa, Artificial Sequence
  synthetic
QSVSSSY

SEQ ID NO: 5557 - DNA, 9 bp, Artificial Sequence
  synthetic
ggtacatcc

SEQ ID NO: 5558 - protein, 3 aa, Artificial Sequence
  synthetic
GTS

SEQ ID NO: 5559 - DNA, 24 bp, Artificial Sequence
  synthetic
cagcagtatggaagctcattcatt

SEQ ID NO: 5560 - protein, 8 aa, Artificial Sequence
  synthetic
QQYGSSFI

SEQ ID NO: 5561 - DNA, 366 bp, Artificial Sequence
  synthetic
gaggtgcagctggtgcagtctgggggaggtttgatacagcctgggggggccctgagactctcctgtgcagcctctggattcacctttagcagcgatgtcatgagttgggtccgccaggctccagggaaggggctggagtgggtctcagctatcagtagtagtggtgatagcatatactacgcagactccgtgaagggccggttcaccatctccagagacaattccaagaacacgctgtatctgcagatgaatggcctgagagccgaggacacggccatatattattgtgcgatagtaggtaactatggtgacttcgccaggtggttcgacccctggggccagggaaccctggtcaccgtctcctca

SEQ ID NO: 5562 - protein, 122 aa, Artificial Sequence
  synthetic
EVQLVQSGGGLIQPGGALRLSCAASGFTFSSDVMSWVRQAPGKGLEWVSAISSSGDSIYYADSVKGRFTISRDNSKNTLYLQMNGLRAEDTAIYYCAIVGNYGDFARWFDPWGQGTLVTVSS

SEQ ID NO: 5563 - DNA, 24 bp, Artificial Sequence
  synthetic
ggattcacctttagcagcgatgtc

SEQ ID NO: 5564 - protein, 8 aa, Artificial Sequence
  synthetic
GFTFSSDV

SEQ ID NO: 5565 - DNA, 24 bp, Artificial Sequence
  synthetic
atcagtagtagtggtgatagcata

SEQ ID NO: 5566 - protein, 8 aa, Artificial Sequence
  synthetic
ISSSGDSI

SEQ ID NO: 5567 - DNA, 45 bp, Artificial Sequence
  synthetic
gcgatagtaggtaactatggtgacttcgccaggtggttcgacccc

SEQ ID NO: 5568 - protein, 15 aa, Artificial Sequence
  synthetic
AIVGNYGDFARWFDP

SEQ ID NO: 5569 - DNA, 324 bp, Artificial Sequence
  synthetic
gacatcctgatgacccagtctccatcctccctgtctgcatctgtaggagacagagtcaccatcacttgccgggcaagtcagaacattaacaactatttaaattggtatcagcagaaaccagggaaagccccgaacctcctgatctatgctgcatccattttgcaaaatggggtcccatcaaggttcagtggcagtggatctgggacagatttcactctcaccatcagcagtctgcaacctgaagattttgcaacttacttctgtcaacagagttacactaccccgctcactttcggcggagggaccaaggtggagatcaaacga

SEQ ID NO: 5570 - protein, 108 aa, Artificial Sequence
  synthetic
DILMTQSPSSLSASVGDRVTITCRASQNINNYLNWYQQKPGKAPNLLIYAASILQNGVPSRFSGSGSGTDFTLTISSLQPEDFATYFCQQSYTTPLTFGGGTKVEIKR

SEQ ID NO: 5571 - DNA, 18 bp, Artificial Sequence
  synthetic
cagaacattaacaactat

SEQ ID NO: 5572 - protein, 6 aa, Artificial Sequence
  synthetic
QNINNY

SEQ ID NO: 5573 - DNA, 9 bp, Artificial Sequence
  synthetic
gctgcatcc

SEQ ID NO: 5574 - protein, 3 aa, Artificial Sequence
  synthetic
AAS

SEQ ID NO: 5575 - DNA, 27 bp, Artificial Sequence
  synthetic
caacagagttacactaccccgctcact

SEQ ID NO: 5576 - protein, 9 aa, Artificial Sequence
  synthetic
QQSYTTPLT

SEQ ID NO: 5577 - DNA, 363 bp, Artificial Sequence
  synthetic
caggtgcagctggtgcagtggggcgcaggactgttgaagccttcggagaccctgtccctcacctgcgctgtctatggtgggtccttcagtgcttcctactggaactggatccgccagcccccagggaggggactggagtggattggggaaatctttcatagtggaaacagcaactacaatccgtccctcaagagtcgagtcaccatttcagtagacacgtccaagaaccacttctccctgaaactgagctctgtgaccgccgcggacacggctatgtattactgtgcgagaggaaagatagaatcggctgtttctgatgcttttgatatctggggccaagggacaatggtcaccgtctcttca

SEQ ID NO: 5578 - protein, 121 aa, Artificial Sequence
  synthetic
QVQLVQWGAGLLKPSETLSLTCAVYGGSFSASYWNWIRQPPGRGLEWIGEIFHSGNSNYNPSLKSRVTISVDTSKNHFSLKLSSVTAADTAMYYCARGKIESAVSDAFDIWGQGTMVTVSS

SEQ ID NO: 5579 - DNA, 24 bp, Artificial Sequence
  synthetic
ggtgggtccttcagtgcttcctac

SEQ ID NO: 5580 - protein, 8 aa, Artificial Sequence
  synthetic
GGSFSASY

SEQ ID NO: 5581 - DNA, 21 bp, Artificial Sequence
  synthetic
atctttcatagtggaaacagc

SEQ ID NO: 5582 - protein, 7 aa, Artificial Sequence
  synthetic
IFHSGNS

SEQ ID NO: 5583 - DNA, 45 bp, Artificial Sequence
  synthetic
gcgagaggaaagatagaatcggctgtttctgatgcttttgatatc

SEQ ID NO: 5584 - protein, 15 aa, Artificial Sequence
  synthetic
ARGKIESAVSDAFDI

SEQ ID NO: 5585 - DNA, 324 bp, Artificial Sequence
  synthetic
gacatcgtgatgacccagtctccaggcaccctgtctttgtctccaggggaaagagccaccctctcctgcagggccagtcagagtgttagcagcagctacttagcctggtaccagcagaaacctggccaggctcccaggctcctcatttatggtacatccagcagggccactggcatcccagacaggttcagtggcagtgggtctgggacagacttcactctcaccatcagcagactggagcctgaggattttgcagtatatttctgtcagcagtatggtaactcattcattttcggccctgggaccaaggtggagatcaaacga

SEQ ID NO: 5586 - protein, 108 aa, Artificial Sequence
  synthetic
DIVMTQSPGTLSLSPGERATLSCRASQSVSSSYLAWYQQKPGQAPRLLIYGTSSRATGIPDRFSGSGSGTDFTLTISRLEPEDFAVYFCQQYGNSFIFGPGTKVEIKR

SEQ ID NO: 5587 - DNA, 21 bp, Artificial Sequence
  synthetic
cagagtgttagcagcagctac

SEQ ID NO: 5588 - protein, 7 aa, Artificial Sequence
  synthetic
QSVSSSY

SEQ ID NO: 5589 - DNA, 9 bp, Artificial Sequence
  synthetic
ggtacatcc

SEQ ID NO: 5590 - protein, 3 aa, Artificial Sequence
  synthetic
GTS

SEQ ID NO: 5591 - DNA, 24 bp, Artificial Sequence
  synthetic
cagcagtatggtaactcattcatt

SEQ ID NO: 5592 - protein, 8 aa, Artificial Sequence
  synthetic
QQYGNSFI

SEQ ID NO: 5593 - DNA, 363 bp, Artificial Sequence
  synthetic
caggtgcagctggtgcagtggggcgcaggactgttgatgccttcggagaccctgtccctcacctgcgctgtctatggtgggtccttcagttattactactggacctggatccgtcagcccccagggaagagactggagtggattggggagatcaatcatagtggaagcaccaactacaacccgtccctcaagagtcgagtcaccatatcagttgacacgcccaagagccagttctccctgaagctgatctctgtgaccgccgcggacacggctgtgtattactgtgcgagaggaataataacatcagctgtctctgatgcttttgatatttggggccaagggacaatggtcaccgtctcctca

SEQ ID NO: 5594 - protein, 121 aa, Artificial Sequence
  synthetic
QVQLVQWGAGLLMPSETLSLTCAVYGGSFSYYYWTWIRQPPGKRLEWIGEINHSGSTNYNPSLKSRVTISVDTPKSQFSLKLISVTAADTAVYYCARGIITSAVSDAFDIWGQGTMVTVSS

SEQ ID NO: 5595 - DNA, 24 bp, Artificial Sequence
  synthetic
ggtgggtccttcagttattactac

SEQ ID NO: 5596 - protein, 8 aa, Artificial Sequence
  synthetic
GGSFSYYY

SEQ ID NO: 5597 - DNA, 21 bp, Artificial Sequence
  synthetic
atcaatcatagtggaagcacc

SEQ ID NO: 5598 - protein, 7 aa, Artificial Sequence
  synthetic
INHSGST

SEQ ID NO: 5599 - DNA, 45 bp, Artificial Sequence
  synthetic
gcgagaggaataataacatcagctgtctctgatgcttttgatatt

SEQ ID NO: 5600 - protein, 15 aa, Artificial Sequence
  synthetic
ARGIITSAVSDAFDI

SEQ ID NO: 5601 - DNA, 324 bp, Artificial Sequence
  synthetic
gacatcgtgatgacccagtctccaggcaccctgtctttgtctccaggggaaagagccaccctctcctgcagggccagtcagagtgttagcagtacctacttagcctggtaccagcagagacctggccaggctcccaggctcctcatctatggaacatccactagggccactggcatcccagacaggttcagtggcagtgggtctgggacagacttcactctcaccatcagcagactggagcctgaagattttgcagtgtattactgtcagcaatttggtgactcattcactttcggccctgggaccaaggtggagatcaaacga

SEQ ID NO: 5602 - protein, 108 aa, Artificial Sequence
  synthetic
DIVMTQSPGTLSLSPGERATLSCRASQSVSSTYLAWYQQRPGQAPRLLIYGTSTRATGIPDRFSGSGSGTDFTLTISRLEPEDFAVYYCQQFGDSFTFGPGTKVEIKR

SEQ ID NO: 5603 - DNA, 21 bp, Artificial Sequence
  synthetic
cagagtgttagcagtacctac

SEQ ID NO: 5604 - protein, 7 aa, Artificial Sequence
  synthetic
QSVSSTY

SEQ ID NO: 5605 - DNA, 9 bp, Artificial Sequence
  synthetic
ggaacatcc

SEQ ID NO: 5606 - protein, 3 aa, Artificial Sequence
  synthetic
GTS

SEQ ID NO: 5607 - DNA, 24 bp, Artificial Sequence
  synthetic
cagcaatttggtgactcattcact

SEQ ID NO: 5608 - protein, 8 aa, Artificial Sequence
  synthetic
QQFGDSFT

SEQ ID NO: 5609 - DNA, 366 bp, Artificial Sequence
  synthetic
gaggtgcagctggtggagtctgggggaggcttgatacagcctgggggggccctgagactctcctgtgcagcctctggattcacctttagcagagatgtcttgagctgggtccgccaggctccagggaaggggctggagtgggtctcacttattagtggtagtggtgataacatatattatgcagactccgtgaagggccggttcaccatctccagagacaattccaagaacacgctgtatctgcagatgaatagcctgagagccgaggacacggccatatattattgtgcgatagttgggaactatggtgacttcgccaggtggttcgacccctggggccagggaaccatggtcaccgtctcctca

SEQ ID NO: 5610 - protein, 122 aa, Artificial Sequence
  synthetic
EVQLVESGGGLIQPGGALRLSCAASGFTFSRDVLSWVRQAPGKGLEWVSLISGSGDNIYYADSVKGRFTISRDNSKNTLYLQMNSLRAEDTAIYYCAIVGNYGDFARWFDPWGQGTMVTVSS

SEQ ID NO: 5611 - DNA, 24 bp, Artificial Sequence
  synthetic
ggattcacctttagcagagatgtc

SEQ ID NO: 5612 - protein, 8 aa, Artificial Sequence
  synthetic
GFTFSRDV

SEQ ID NO: 5613 - DNA, 24 bp, Artificial Sequence
  synthetic
attagtggtagtggtgataacata

SEQ ID NO: 5614 - protein, 8 aa, Artificial Sequence
  synthetic
ISGSGDNI

SEQ ID NO: 5615 - DNA, 45 bp, Artificial Sequence
  synthetic
gcgatagttgggaactatggtgacttcgccaggtggttcgacccc

SEQ ID NO: 5616 - protein, 15 aa, Artificial Sequence
  synthetic
AIVGNYGDFARWFDP

SEQ ID NO: 5617 - DNA, 324 bp, Artificial Sequence
  synthetic
gacatcctgatgacccagtctccatcctccctgtctgcatctgtaggagacagagtcaccatcacttgccgggcaagtcagagcattagcagctatttaaattggtatcagcggaaaccagggaaagccccgaacctcctgatctatgctgcatccattttgcaaaatggggtcccatcaaggttcagtggcagtggatctgggacagatttcactctcaccatcagcagtctgcaacctgaagattttgcaacttacttctgtcaacagagttacactaccccgctcactttcggcggagggaccaaggtggagatcaaacga

SEQ ID NO: 5618 - protein, 108 aa, Artificial Sequence
  synthetic
DILMTQSPSSLSASVGDRVTITCRASQSISSYLNWYQRKPGKAPNLLIYAASILQNGVPSRFSGSGSGTDFTLTISSLQPEDFATYFCQQSYTTPLTFGGGTKVEIKR

SEQ ID NO: 5619 - DNA, 18 bp, Artificial Sequence
  synthetic
cagagcattagcagctat

SEQ ID NO: 5620 - protein, 6 aa, Artificial Sequence
  synthetic
QSISSY

SEQ ID NO: 5621 - DNA, 9 bp, Artificial Sequence
  synthetic
gctgcatcc

SEQ ID NO: 5622 - protein, 3 aa, Artificial Sequence
  synthetic
AAS

SEQ ID NO: 5623 - DNA, 27 bp, Artificial Sequence
  synthetic
caacagagttacactaccccgctcact

SEQ ID NO: 5624 - protein, 9 aa, Artificial Sequence
  synthetic
QQSYTTPLT

SEQ ID NO: 5625 - DNA, 366 bp, Artificial Sequence
  synthetic
caggtgcagctggtggagtctggcgcaggactgttgaagccttcggagaccctgtccctcacctgcgctgtctatggtgggtccttcagtacttactattggagctggatccgccagcccccagggaaggggctggagtggattggggaaatcaatcatactggaagcaccaactacaacccgtccctcaagagtcgagtcaccatatcagtagacacgtccaagaaccagttctccctgaagctgaactctgtgaccgccgcggacacgtctgtatattactgtgcgagaggccctagtacattaactacagactactacggtttggacgtctggggccaagggaccacggtcaccgtctcctca

SEQ ID NO: 5626 - protein, 122 aa, Artificial Sequence
  synthetic
QVQLVESGAGLLKPSETLSLTCAVYGGSFSTYYWSWIRQPPGKGLEWIGEINHTGSTNYNPSLKSRVTISVDTSKNQFSLKLNSVTAADTSVYYCARGPSTLTTDYYGLDVWGQGTTVTVSS

SEQ ID NO: 5627 - DNA, 24 bp, Artificial Sequence
  synthetic
ggtgggtccttcagtacttactat

SEQ ID NO: 5628 - protein, 8 aa, Artificial Sequence
  synthetic
GGSFSTYY

SEQ ID NO: 5629 - DNA, 21 bp, Artificial Sequence
  synthetic
atcaatcatactggaagcacc

SEQ ID NO: 5630 - protein, 7 aa, Artificial Sequence
  synthetic
INHTGST

SEQ ID NO: 5631 - DNA, 48 bp, Artificial Sequence; identical to SEQ ID NO: 5439
  synthetic

SEQ ID NO: 5632 - protein, 16 aa, Artificial Sequence
  synthetic
ARGPSTLTTDYYGLDV

SEQ ID NO: 5633 - DNA, 327 bp, Artificial Sequence
  synthetic
gacatcgtgatgacccagtctccaggcaccctgtctttgtctccaggggaaagagccaccctctcctgcagggccagtcagagtattagcagcagctacttagcctggtaccagcaaaaacctggccaggctcccaggctcctcatctatgatgcatccagcaggtccactgacatcccagacaggttcagtggcagtgggtctgggacagacttcactctcaccatcagcagactggagcctgaagattttgcactgtattactgtcagcagtatggtggctcaccattcactttcggccctgggaccaaggtggagatcaaacga

SEQ ID NO: 5634 - protein, 109 aa, Artificial Sequence
  synthetic
DIVMTQSPGTLSLSPGERATLSCRASQSISSSYLAWYQQKPGQAPRLLIYDASSRSTDIPDRFSGSGSGTDFTLTISRLEPEDFALYYCQQYGGSPFTFGPGTKVEIKR

SEQ ID NO: 5635 - DNA, 21 bp, Artificial Sequence
  synthetic
cagagtattagcagcagctac

SEQ ID NO: 5636 - protein, 7 aa, Artificial Sequence
  synthetic
QSISSSY

SEQ ID NO: 5637 - DNA, 9 bp, Artificial Sequence
  synthetic
gatgcatcc

SEQ ID NO: 5638 - protein, 3 aa, Artificial Sequence
  synthetic
DAS

SEQ ID NO: 5639 - DNA, 27 bp, Artificial Sequence
  synthetic
cagcagtatggtggctcaccattcact

SEQ ID NO: 5640 - protein, 9 aa, Artificial Sequence
  synthetic
QQYGGSPFT

SEQ ID NO: 5641 - DNA, 363 bp, Artificial Sequence
  synthetic
caggtgcagctggtgcagtggggcgcaggactgttgatgccttcggagaccctgtccctcacctgcgctgtctctggtgggtccttcagttattactactggacctggatccgccagcccccagggaagggtctggagtggattggggagatcaatcatagtggaagcaccaactacaacccgtccctcaagagtcgaatcaccatatcagtagacacgtccaagaaccagttctccctgaaactgaactctgtgaccgccgcggacacggctgtgtattattgtgcgagaggacagataacagcagctgtctctgattcttttgatgtctggggccaagggacaatggtcaccgtctcctca

SEQ ID NO: 5642 - protein, 121 aa, Artificial Sequence
  synthetic
QVQLVQWGAGLLMPSETLSLTCAVSGGSFSYYYWTWIRQPPGKGLEWIGEINHSGSTNYNPSLKSRITISVDTSKNQFSLKLNSVTAADTAVYYCARGQITAAVSDSFDVWGQGTMVTVSS

SEQ ID NO: 5643 - DNA, 24 bp, Artificial Sequence
  synthetic
ggtgggtccttcagttattactac

SEQ ID NO: 5644 - protein, 8 aa, Artificial Sequence
  synthetic
GGSFSYYY

SEQ ID NO: 5645 - DNA, 21 bp, Artificial Sequence
  synthetic
atcaatcatagtggaagcacc

SEQ ID NO: 5646 - protein, 7 aa, Artificial Sequence
  synthetic
INHSGST

SEQ ID NO: 5647 - DNA, 45 bp, Artificial Sequence
  synthetic
gcgagaggacagataacagcagctgtctctgattcttttgatgtc

SEQ ID NO: 5648 - protein, 15 aa, Artificial Sequence
  synthetic
ARGQITAAVSDSFDV

SEQ ID NO: 5649 - DNA, 324 bp, Artificial Sequence
  synthetic
gacatcgtgatgacccagtctccaggcaccctgtctttgtctccaggggaaagagtcaccctctcctgtagggccagtcagtttgttagcagcagctattcagcctggtaccagcagagacctggccagcctcccagactcctcatctatggtgcatccagcagggccactggcatcccagacaggttcagtggcagtgggtctgggacagacttcactctcaccatcagcagactggagcctgaagattttgcagtgtattattgtcaacagtatggtagcgcattcattttcggccctgggaccaaggtggagatcaaacga

SEQ ID NO: 5650 - protein, 108 aa, Artificial Sequence
  synthetic
DIVMTQSPGTLSLSPGERVTLSCRASQFVSSSYSAWYQQRPGQPPRLLIYGASSRATGIPDRFSGSGSGTDFTLTISRLEPEDFAVYYCQQYGSAFIFGPGTKVEIKR

SEQ ID NO: 5651 - DNA, 21 bp, Artificial Sequence
  synthetic
cagtttgttagcagcagctat

SEQ ID NO: 5652 - protein, 7 aa, Artificial Sequence
  synthetic
QFVSSSY

SEQ ID NO: 5653 - DNA, 9 bp, Artificial Sequence
  synthetic
ggtgcatcc

SEQ ID NO: 5654 - protein, 3 aa, Artificial Sequence
  synthetic
GAS

SEQ ID NO: 5655 - DNA, 24 bp, Artificial Sequence
  synthetic
caacagtatggtagcgcattcatt

SEQ ID NO: 5656 - protein, 8 aa, Artificial Sequence
  synthetic
QQYGSAFI

SEQ ID NO: 5657 - DNA, 375 bp, Artificial Sequence
  synthetic
caggtgcagctggtggagtctgggggaggcgtggtgcggcctggggggtccctgagactctcctgtgcagcctctggattcacctttgatgattatgccatgagctgggtccgccaagttccagggaaggggctggagtgggtctctggtattaattggaatggtgatagtagaggttatgcagactctgtgaggggccgattcaccatctccagagacaacgccaagaactccctgtatctgcaaatgaacagtctgagagccgaggacacggccttgtattattgtgcgagagatagggatggaggtcctccttcctattactattatgggatggacgtctggggccaagggaccacggtcaccgtctcctca

SEQ ID NO: 5658 - protein, 125 aa, Artificial Sequence
  synthetic
QVQLVESGGGVVRPGGSLRLSCAASGFTFDDYAMSWVRQVPGKGLEWVSGINWNGDSRGYADSVRGRFTISRDNAKNSLYLQMNSLRAEDTALYYCARDRDGGPPSYYYYGMDVWGQGTTVTVSS

SEQ ID NO: 5659 - DNA, 24 bp, Artificial Sequence
  synthetic
ggattcacctttgatgattatgcc

SEQ ID NO: 5660 - protein, 8 aa, Artificial Sequence
  synthetic
GFTFDDYA

SEQ ID NO: 5661 - DNA, 24 bp, Artificial Sequence
  synthetic
attaattggaatggtgatagtaga

SEQ ID NO: 5662 - protein, 8 aa, Artificial Sequence
  synthetic
INWNGDSR

SEQ ID NO: 5663 - DNA, 54 bp, Artificial Sequence
  synthetic
gcgagagatagggatggaggtcctccttcctattactattatgggatggacgtc

SEQ ID NO: 5664 - protein, 18 aa, Artificial Sequence
  synthetic
ARDRDGGPPSYYYYGMDV

SEQ ID NO: 5665 - DNA, 324 bp, Artificial Sequence
  synthetic
gacatcgtgatgacccagtctccagccaccctgtctttgtctccaggggaaagagccaccctctcctgcagggccagtcagaatattaacgactatttagcctggtaccaacagaaacctggccaggctcccaggctcctcatctatgatgcatccaacagggccactggcatcccagccaggttcagtggcagtgggtctgggacagacttcactctcaccatcagtagcctagagcctgaagattttgcagtttattactgtcagcagcgtagcaatcggccgctcactttcggcggagggaccaaggtggagatcaaacga

SEQ ID NO: 5666 - protein, 108 aa, Artificial Sequence
  synthetic
DIVMTQSPATLSLSPGERATLSCRASQNINDYLAWYQQKPGQAPRLLIYDASNRATGIPARFSGSGSGTDFTLTISSLEPEDFAVYYCQQRSNRPLTFGGGTKVEIKR

SEQ ID NO: 5667 - DNA, 18 bp, Artificial Sequence
  synthetic
cagaatattaacgactat

SEQ ID NO: 5668 - protein, 6 aa, Artificial Sequence
  synthetic
QNINDY

SEQ ID NO: 5669 - DNA, 9 bp, Artificial Sequence
  synthetic
gatgcatcc

SEQ ID NO: 5670 - protein, 3 aa, Artificial Sequence
  synthetic
DAS

SEQ ID NO: 5671 - DNA, 27 bp, Artificial Sequence
  synthetic
cagcagcgtagcaatcggccgctcact

SEQ ID NO: 5672 - protein, 9 aa, Artificial Sequence
  synthetic
QQRSNRPLT

SEQ ID NO: 5673 - DNA, 363 bp, Artificial Sequence
  synthetic
caggtgcagctggtgcagtggggcgcaggactgttgaagccttcggagaccctgtccctcacctgtgctgtctatggtgggtccttcagttcttcctactggaactggatccgccagcccccagggaggggactggagtggattggggaaatctttcatagtggaaacaccaactacaacccgtccctcaagagtcgagtcaccatatcagtagacacgtccaagaaccacttctccctgaaactgagctctgtgaccgccgcggacacggctgtgtattactgtgcgagaggaaagatagaatcggctgtttctgattcttttgatatctggggccaagggacaatggtcaccgtctcctca

SEQ ID NO: 5674 - protein, 121 aa, Artificial Sequence
  synthetic
QVQLVQWGAGLLKPSETLSLTCAVYGGSFSSSYWNWIRQPPGRGLEWIGEIFHSGNTNYNPSLKSRVTISVDTSKNHFSLKLSSVTAADTAVYYCARGKIESAVSDSFDIWGQGTMVTVSS

SEQ ID NO: 5675 - DNA, 24 bp, Artificial Sequence
  synthetic
ggtgggtccttcagttcttcctac

SEQ ID NO: 5676 - protein, 8 aa, Artificial Sequence
  synthetic
GGSFSSSY

SEQ ID NO: 5677 - DNA, 21 bp, Artificial Sequence
  synthetic
atctttcatagtggaaacacc

SEQ ID NO: 5678 - protein, 7 aa, Artificial Sequence
  synthetic
IFHSGNT

SEQ ID NO: 5679 - DNA, 45 bp, Artificial Sequence; identical to SEQ ID NO: 5551
  synthetic

SEQ ID NO: 5680 - protein, 15 aa, Artificial Sequence
  synthetic
ARGKIESAVSDSFDI

SEQ ID NO: 5681 - DNA, 324 bp, Artificial Sequence
  synthetic
gacatcgtgatgacccagtctccaggcaccctgtctttgtctccaggggaaagagccaccctctcctgcagggccagtcagagtgttagcagcagctacttagcctggtaccagcagaaacctggccaggctcccaggctcctcatctatggtacatccagcagggccactggcatcccagacaggttcagtggcagtgggtctgggacagacttcactctcaccatcagcagactggagcctgaagactttgcagtgtatttctgtcagcagtatggtagctcattcattttcggccctgggaccaaggtggagatcaaacga

SEQ ID NO: 5682 - protein, 108 aa, Artificial Sequence; identical to SEQ ID NO: 5554
  synthetic

SEQ ID NO: 5683 - DNA, 21 bp, Artificial Sequence
  synthetic
cagagtgttagcagcagctac

SEQ ID NO: 5684 - protein, 7 aa, Artificial Sequence
  synthetic
QSVSSSY

SEQ ID NO: 5685 - DNA, 9 bp, Artificial Sequence
  synthetic
ggtacatcc

SEQ ID NO: 5686 - protein, 3 aa, Artificial Sequence
  synthetic
GTS

SEQ ID NO: 5687 - DNA, 24 bp, Artificial Sequence
  synthetic
cagcagtatggtagctcattcatt

SEQ ID NO: 5688 - protein, 8 aa, Artificial Sequence
  synthetic
QQYGSSFI

SEQ ID NO: 5689 - DNA, 366 bp, Artificial Sequence
  synthetic
caggtgcagctggtggagtctgggggaggcatggtacagccgggggggtccctgagactctcctgtgcagcctctggattcacctttagcagttatgccatgacctgggtccgccaggctccaggaaaggggctggagtgggtctcagctattagtagtagtggtggtagttcatactacgcagactccgtgaagggccggttcaccatctccagagacaattccaagaacacactttatctgcaaatgaacagtctgagagccgaggacacggccgtatattactgtgcgaaagatctgggggccctcggctactactacggtattgacgtctggggccaagggaccatggtcaccgtctcctca

SEQ ID NO: 5690 - protein, 122 aa, Artificial Sequence
  synthetic
QVQLVESGGGMVQPGGSLRLSCAASGFTFSSYAMTWVRQAPGKGLEWVSAISSSGGSSYYADSVKGRFTISRDNSKNTLYLQMNSLRAEDTAVYYCAKDLGALGYYYGIDVWGQGTMVTVSS

SEQ ID NO: 5691 - DNA, 24 bp, Artificial Sequence
  synthetic
ggattcacctttagcagttatgcc

SEQ ID NO: 5692 - protein, 8 aa, Artificial Sequence
  synthetic
GFTFSSYA

SEQ ID NO: 5693 - DNA, 24 bp, Artificial Sequence
  synthetic
attagtagtagtggtggtagttca

SEQ ID NO: 5694 - protein, 8 aa, Artificial Sequence
  synthetic
ISSSGGSS

SEQ ID NO: 5695 - DNA, 45 bp, Artificial Sequence
  synthetic
gcgaaagatctgggggccctcggctactactacggtattgacgtc

SEQ ID NO: 5696 - protein, 15 aa, Artificial Sequence
  synthetic
AKDLGALGYYYGIDV

SEQ ID NO: 5697 - DNA, 324 bp, Artificial Sequence
  synthetic
gacatcgtgatgacccagtctccagccaccctgtctttgtctccaggggaaagagccaccctctcctgcagggccagtcagagtgttagcaactacttagcctggtaccaacagagacctggccaggctcccaggctcctcatctataatgcatccaacaggtcccctggcatccaagccaggttcagtggcagtggttctggaacagacttcactctcaccatcagcagactggaacctgaagattttgcagtttattcctgtcagcagcgtagcaactggccgtggacattcggccaagggaccaaggtggagatcaaacga

SEQ ID NO: 5698 - protein, 108 aa, Artificial Sequence
  synthetic
DIVMTQSPATLSLSPGERATLSCRASQSVSNYLAWYQQRPGQAPRLLIYNASNRSPGIQARFSGSGSGTDFTLTISRLEPEDFAVYSCQQRSNWPWTFGQGTKVEIKR

SEQ ID NO: 5699 - DNA, 18 bp, Artificial Sequence
  synthetic
cagagtgttagcaactac

SEQ ID NO: 5700 - protein, 6 aa, Artificial Sequence
  synthetic
QSVSNY

SEQ ID NO: 5701 - DNA, 9 bp, Artificial Sequence
  synthetic
aatgcatcc

SEQ ID NO: 5702 - protein, 3 aa, Artificial Sequence
  synthetic
NAS

SEQ ID NO: 5703 - DNA, 27 bp, Artificial Sequence
  synthetic
cagcagcgtagcaactggccgtggaca

SEQ ID NO: 5704 - protein, 9 aa, Artificial Sequence
  synthetic
QQRSNWPWT

SEQ ID NO: 5705 - DNA, 354 bp, Artificial Sequence
  synthetic
caggtgcagctggtggagtctgggggaggcttggtacagccgggggggtccctgagactctcctgtgcagcctctggattcacctttagcagctatgccatgacctgggtccgtcaggctccagggaaggggctggagtgggtctcaagtattagtagtagtggtgttagcacatattacgcagactccgtgaagggccggttcaccatctccagagacaattccaagaacacgctgtatctgcaactgagcagcctgagagccgaggacacggccatatattactgtgccaaaggcagcagctggtactactttgaatcctggggccagggaaccatggtcaccgtctcctca

SEQ ID NO: 5706 - protein, 118 aa, Artificial Sequence
  synthetic
QVQLVESGGGLVQPGGSLRLSCAASGFTFSSYAMTWVRQAPGKGLEWVSSISSSGVSTYYADSVKGRFTISRDNSKNTLYLQLSSLRAEDTAIYYCAKGSSWYYFESWGQGTMVTVSS

SEQ ID NO: 5707 - DNA, 24 bp, Artificial Sequence
  synthetic
ggattcacctttagcagctatgcc

SEQ ID NO: 5708 - protein, 8 aa, Artificial Sequence
  synthetic
GFTFSSYA

SEQ ID NO: 5709 - DNA, 24 bp, Artificial Sequence
  synthetic
attagtagtagtggtgttagcaca

SEQ ID NO: 5710 - protein, 8 aa, Artificial Sequence
  synthetic
ISSSGVST

SEQ ID NO: 5711 - DNA, 33 bp, Artificial Sequence
  synthetic
gccaaaggcagcagctggtactactttgaatcc

SEQ ID NO: 5712 - protein, 11 aa, Artificial Sequence
  synthetic
AKGSSWYYFES

SEQ ID NO: 5713 - DNA, 327 bp, Artificial Sequence
  synthetic
gacatcgtgatgacccagtctccaggcaccctgtctttgtctccaggggagagagccaccctctcctgcagggccagtcagagtgttagcagcagctacttagcctggtaccagcaaaaacctggccaggctcccaggctcctcatctatggtgcatccagcagggccactggcatcccagacaggttcagtggcagtgggtctgggacagacttcactctcaccatcagaagactggagcctgaagattttgcagtgtatttctgtcagcagtatggtagctcaccgatcaccttcggccaagggacacgactggagatcaaacga

SEQ ID NO: 5714 - protein, 109 aa, Artificial Sequence
  synthetic
DIVMTQSPGTLSLSPGERATLSCRASQSVSSSYLAWYQQKPGQAPRLLIYGASSRATGIPDRFSGSGSGTDFTLTIRRLEPEDFAVYFCQQYGSSPITFGQGTRLEIKR

SEQ ID NO: 5715 - DNA, 21 bp, Artificial Sequence
  synthetic
cagagtgttagcagcagctac

SEQ ID NO: 5716 - protein, 7 aa, Artificial Sequence
  synthetic
QSVSSSY

SEQ ID NO: 5717 - DNA, 9 bp, Artificial Sequence
  synthetic
ggtgcatcc

SEQ ID NO: 5718 - protein, 3 aa, Artificial Sequence
  synthetic
GAS

SEQ ID NO: 5719 - DNA, 27 bp, Artificial Sequence
  synthetic
cagcagtatggtagctcaccgatcacc

SEQ ID NO: 5720 - protein, 9 aa, Artificial Sequence
  synthetic
QQYGSSPIT

SEQ ID NO: 5721 - DNA, 372 bp, Artificial Sequence
  synthetic
gaggtgcagctggtggagtctgggggaggcatggtaaagcctggggggtcccttagactctcctgtgcagcctctggatttactttcagaaacgcctggatgagctgggtccgccaggctccagggagggggctggagtgggttggccgtattaaaagcaaaactgatggtgggacaacagactacgctgcacccgtgaaaggcagattcaccatctcaagagatgattcaaaaaacacactatatctgcaaatgaacagcctgaaaaccgaggacatagccatgtattactgtaccacttataaatggaacttctttggtaactggtccttcgatatctggggccatggcaccctggtcaccgtctcctca

SEQ ID NO: 5722 - protein, 124 aa, Artificial Sequence
  synthetic
EVQLVESGGGMVKPGGSLRLSCAASGFTFRNAWMSWVRQAPGRGLEWVGRIKSKTDGGTTDYAAPVKGRFTISRDDSKNTLYLQMNSLKTEDIAMYYCTTYKWNFFGNWSFDIWGHGTLVTVSS

SEQ ID NO: 5723 - DNA, 24 bp, Artificial Sequence
  synthetic
ggatttactttcagaaacgcctgg

SEQ ID NO: 5724 - protein, 8 aa, Artificial Sequence
  synthetic
GFTFRNAW

SEQ ID NO: 5725 - DNA, 30 bp, Artificial Sequence
  synthetic
attaaaagcaaaactgatggtgggacaaca

SEQ ID NO: 5726 - protein, 10 aa, Artificial Sequence
  synthetic
IKSKTDGGTT

SEQ ID NO: 5727 - DNA, 45 bp, Artificial Sequence
  synthetic
accacttataaatggaacttctttggtaactggtccttcgatatc

SEQ ID NO: 5728 - protein, 15 aa, Artificial Sequence
  synthetic
TTYKWNFFGNWSFDI

SEQ ID NO: 5729 - DNA, 324 bp, Artificial Sequence
  synthetic
gacatccagatgacccagtctccatcctccctgtctgcatctgttagagacagagtcaccatcacttgccgggcaagtcagagtattagcagatatttaaattggtatcaacagaaaccagggaaagccccgaacctcctgatctatgctgcatccagtttggaacgtggggtcccatcaaggttcagtgccagtggatctgggacagatttcactctcaccatcagcagtccgcaacctgaagattatggaacttactactgtcaacagagtttcagtagtccgatcaccttcggccaagggacacgactggagattaaacga

SEQ ID NO: 5730 - protein, 108 aa, Artificial Sequence
  synthetic
DIQMTQSPSSLSASVRDRVTITCRASQSISRYLNWYQQKPGKAPNLLIYAASSLERGVPSRFSASGSGTDFTLTISSPQPEDYGTYYCQQSFSSPITFGQGTRLEIKR

SEQ ID NO: 5731 - DNA, 18 bp, Artificial Sequence
  synthetic
cagagtattagcagatat

SEQ ID NO: 5732 - protein, 6 aa, Artificial Sequence
  synthetic
QSISRY

SEQ ID NO: 5733 - DNA, 9 bp, Artificial Sequence
  synthetic
gctgcatcc

SEQ ID NO: 5734 - protein, 3 aa, Artificial Sequence
  synthetic
AAS

SEQ ID NO: 5735 - DNA, 27 bp, Artificial Sequence
  synthetic
caacagagtttcagtagtccgatcacc

SEQ ID NO: 5736 - protein, 9 aa, Artificial Sequence
  synthetic
QQSFSSPIT

SEQ ID NO: 5737 - DNA, 366 bp, Artificial Sequence
  synthetic
caggtgcagctggtgcagtggggcgcaggactgttgaagccttcggagaccctgtccctcacctgcgctgtctatggtaggtccttcagttattactattggacctggatccgccagcccccagggaagggactggagtggattggggaaatcaatcatactggaagcaccaactgcaacccgtccctcaagagtcgagtcaccctatcagtagacacgtccaagaaccagttctccctgaacctgaactctgtgaccgccgcggacacggctgtgtattactgtgcgcgaggcccctattcagtaactacggactactacggcttggacgtctggggccaagggaccacggtcaccgtctcctca

SEQ ID NO: 5738 - protein, 122 aa, Artificial Sequence
  synthetic
QVQLVQWGAGLLKPSETLSLTCAVYGRSFSYYYWTWIRQPPGKGLEWIGEINHTGSTNCNPSLKSRVTLSVDTSKNQFSLNLNSVTAADTAVYYCARGPYSVTTDYYGLDVWGQGTTVTVSS

SEQ ID NO: 5739 - DNA, 24 bp, Artificial Sequence
  synthetic
ggtaggtccttcagttattactat

SEQ ID NO: 5740 - protein, 8 aa, Artificial Sequence
  synthetic
GRSFSYYY

SEQ ID NO: 5741 - DNA, 21 bp, Artificial Sequence
  synthetic
atcaatcatactggaagcacc

SEQ ID NO: 5742 - protein, 7 aa, Artificial Sequence
  synthetic
INHTGST

SEQ ID NO: 5743 - DNA, 48 bp, Artificial Sequence
  synthetic
gcgcgaggcccctattcagtaactacggactactacggcttggacgtc

SEQ ID NO: 5744 - protein, 16 aa, Artificial Sequence
  synthetic
ARGPYSVTTDYYGLDV

SEQ ID NO: 5745 - DNA, 327 bp, Artificial Sequence
  synthetic
gacatcgtgatgacccagtctccaggcaccctgtctttgtctccaggggaaagagtcaccctctcctgcaggaccagtcagagtgttaccaacaactacttggcctggtaccagcagaaacctggccaggctcccaggctcctcatctatgatacatccagcagggccactggcatcccagacaggttcagtggcagtgggtctgggacagacttcactctcaccatcagcagactggagcctgacgattttgcagtgtattactgtcagcagtttgcttacttaccgtccacttttggccaggggaccaaggtggagatcaaacga

SEQ ID NO: 5746 - protein, 109 aa, Artificial Sequence
  synthetic
DIVMTQSPGTLSLSPGERVTLSCRTSQSVTNNYLAWYQQKPGQAPRLLIYDTSSRATGIPDRFSGSGSGTDFTLTISRLEPDDFAVYYCQQFAYLPSTFGQGTKVEIKR

SEQ ID NO: 5747 - DNA, 21 bp, Artificial Sequence
  synthetic
cagagtgttaccaacaactac

SEQ ID NO: 5748 - protein, 7 aa, Artificial Sequence
  synthetic
QSVTNNY

SEQ ID NO: 5749 - DNA, 9 bp, Artificial Sequence
  synthetic
gatacatcc

SEQ ID NO: 5750 - protein, 3 aa, Artificial Sequence
  synthetic
DTS

SEQ ID NO: 5751 - DNA, 27 bp, Artificial Sequence
  synthetic
cagcagtttgcttacttaccgtccact

SEQ ID NO: 5752 - protein, 9 aa, Artificial Sequence
  synthetic
QQFAYLPST

SEQ ID NO: 5753 - DNA, 366 bp, Artificial Sequence
  synthetic
caggtgcagctggtgcagtggggcgcaggactgttgaagccttcggagaccctgtccctcacctgcgctgtctatggtgggtccttcaatatttactactggagctggatccgccagcccccagggaaggggctggagtggattggggaaatcaatcatactggtagcaccaactaccacccgtccctcaagagtcgagtcaccatatcagtagacacgtccaggaaccagttctccctgaacctgagctctgtgaccgccgcggacacggctgtttattactgtgcgagaggcccctatacagtaactacggactactacggtatggacgtctggggccgagggaccacggtcaccgtctcctca

SEQ ID NO: 5754 - protein, 122 aa, Artificial Sequence
  synthetic
QVQLVQWGAGLLKPSETLSLTCAVYGGSFNIYYWSWIRQPPGKGLEWIGEINHTGSTNYHPSLKSRVTISVDTSRNQFSLNLSSVTAADTAVYYCARGPYTVTTDYYGMDVWGRGTTVTVSS

SEQ ID NO: 5755 - DNA, 24 bp, Artificial Sequence
  synthetic
ggtgggtccttcaatatttactac

SEQ ID NO: 5756 - protein, 8 aa, Artificial Sequence
  synthetic
GGSFNIYY

SEQ ID NO: 5757 - DNA, 21 bp, Artificial Sequence
  synthetic
atcaatcatactggtagcacc

SEQ ID NO: 5758 - protein, 7 aa, Artificial Sequence
  synthetic
INHTGST

SEQ ID NO: 5759 - DNA, 48 bp, Artificial Sequence
  synthetic
gcgagaggcccctatacagtaactacggactactacggtatggacgtc

SEQ ID NO: 5760 - protein, 16 aa, Artificial Sequence
  synthetic
ARGPYTVTTDYYGMDV

SEQ ID NO: 5761 - DNA, 327 bp, Artificial Sequence
  synthetic
gacatcgtgatgacccagtctccaggcaccctgtctttgtctccaggggaaagagccaccctctcctgcagggccagtcagagtgttagcagcagctacttagcctggtaccaccagaaacctggccaggctcccagtctcctcatctatgatacatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaacga

SEQ ID NO: 5762 - protein, 109 aa, Artificial Sequence
  synthetic
DIVMTQSPGTLSLSPGERATLSCRASQSVSSSYLAWYHQKPGQAPSLLIYDTSSRATGIPDRFSGSGSGTDFTLTISRLEPEDFAVYYCQQYGSSPLTFGGGTKVEIKR

SEQ ID NO: 5763 - DNA, 21 bp, Artificial Sequence
  synthetic
cagagtgttagcagcagctac

SEQ ID NO: 5764 - protein, 7 aa, Artificial Sequence
  synthetic
QSVSSSY

SEQ ID NO: 5765 - DNA, 9 bp, Artificial Sequence
  synthetic
gatacatcc

SEQ ID NO: 5766 - protein, 3 aa, Artificial Sequence
  synthetic
DTS

SEQ ID NO: 5767 - DNA, 27 bp, Artificial Sequence
  synthetic
cagcagtatggtagctcaccgctcact

SEQ ID NO: 5768 - protein, 9 aa, Artificial Sequence
  synthetic
QQYGSSPLT

SEQ ID NO: 5769 - DNA, 366 bp, Artificial Sequence
  synthetic
caggtgcagctggtgcagtggggcgcaggactgttgaagccttcggagaccctgtccctcacctgcgttgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaacctgagctctgtgaccgccgcggacacggctgtgtattactgtgcgagaggcccattttacgatattttgactggttattcccttgactactggggccagggaaccctggtcaccgtctcctca

SEQ ID NO: 5770 - protein, 122 aa, Artificial Sequence
  synthetic
QVQLVQWGAGLLKPSETLSLTCVVYGGSFSGYYWSWIRQPPGKGLEWIGEINHSGSTNYNPSLKSRVTISVDTSKNQFSLNLSSVTAADTAVYYCARGPFYDILTGYSLDYWGQGTLVTVSS

SEQ ID NO: 5771 - DNA, 24 bp, Artificial Sequence
  synthetic
ggtgggtccttcagtggttactac

SEQ ID NO: 5772 - protein, 8 aa, Artificial Sequence
  synthetic
GGSFSGYY

SEQ ID NO: 5773 - DNA, 21 bp, Artificial Sequence
  synthetic
atcaatcatagtggaagcacc

SEQ ID NO: 5774 - protein, 7 aa, Artificial Sequence
  synthetic
INHSGST

SEQ ID NO: 5775 - DNA, 48 bp, Artificial Sequence
  synthetic
gcgagaggcccattttacgatattttgactggttattcccttgactac

SEQ ID NO: 5776 - protein, 16 aa, Artificial Sequence
  synthetic
ARGPFYDILTGYSLDY

SEQ ID NO: 5777 - DNA, 324 bp, Artificial Sequence
  synthetic
gacatcgtgatgacccagtctccagccaccctgtctttgtctccaggggaaagagccaccctctcctgcagggccagtcagagtgttagcagctacttaacctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctatcaccttcggccaagggacacgactggagattaaacga

SEQ ID NO: 5778 - protein, 108 aa, Artificial Sequence
  synthetic
DIVMTQSPATLSLSPGERATLSCRASQSVSSYLTWYQQKPGQAPRLLIYDASNRATGIPARFSGSGSGTDFTLTISSLEPEDFAVYYCQQRSNWPITFGQGTRLEIKR

SEQ ID NO: 5779 - DNA, 18 bp, Artificial Sequence
  synthetic
cagagtgttagcagctac

SEQ ID NO: 5780 - protein, 6 aa, Artificial Sequence
  synthetic
QSVSSY

SEQ ID NO: 5781 - DNA, 9 bp, Artificial Sequence
  synthetic
gatgcatcc

SEQ ID NO: 5782 - protein, 3 aa, Artificial Sequence
  synthetic
DAS

SEQ ID NO: 5783 - DNA, 27 bp, Artificial Sequence
  synthetic
cagcagcgtagcaactggcctatcacc

SEQ ID NO: 5784 - protein, 9 aa, Artificial Sequence
  synthetic
QQRSNWPIT

SEQ ID NO: 5785 - DNA, 372 bp, Artificial Sequence
  synthetic
gaggtgcagctggtggagtctgggggaggcttggtacagcctggcaggtccctgagactctcctgtacagcctctggattcacctttgatgattttgccatgcactgggtccggcaaggtccagggaagggcctggagtgggtctcaggtattaattggaatagtggtagtataggctatgcggactctgtgaagggccgattcaccatctccagagacaacgccaagaactccctgtttctgcaaatgaacagtctgagacctgaggacacggccttctattactgtgcaaaagatattgcagcagccgggttctcctactactacggtatggacgtctggggccaagggaccatggtcaccgtctcctca

SEQ ID NO: 5786 - protein, 124 aa, Artificial Sequence
  synthetic
EVQLVESGGGLVQPGRSLRLSCTASGFTFDDFAMHWVRQGPGKGLEWVSGINWNSGSIGYADSVKGRFTISRDNAKNSLFLQMNSLRPEDTAFYYCAKDIAAAGFSYYYGMDVWGQGTMVTVSS

SEQ ID NO: 5787 - DNA, 24 bp, Artificial Sequence
  synthetic
ggattcacctttgatgattttgcc

SEQ ID NO: 5788 - protein, 8 aa, Artificial Sequence
  synthetic
GFTFDDFA

SEQ ID NO: 5789 - DNA, 24 bp, Artificial Sequence
  synthetic
attaattggaatagtggtagtata

SEQ ID NO: 5790 - protein, 8 aa, Artificial Sequence
  synthetic
INWNSGSI

SEQ ID NO: 5791 - DNA, 51 bp, Artificial Sequence
  synthetic
gcaaaagatattgcagcagccgggttctcctactactacggtatggacgtc

SEQ ID NO: 5792 - protein, 17 aa, Artificial Sequence
  synthetic
AKDIAAAGFSYYYGMDV

SEQ ID NO: 5793 - DNA, 324 bp, Artificial Sequence
  synthetic
gacatcctgatgacccagtctccatccttcctgtctgcatctgtaggagacagagtcaccatcacttgttgggccagtcagggcattaataattatttagtctggtatcagcagaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaggtggagatcaaacga

SEQ ID NO: 5794 - protein, 108 aa, Artificial Sequence
  synthetic
DILMTQSPSFLSASVGDRVTITCWASQGINNYLVWYQQKPGKAPKLLIYAASTLQSGVPSRFSGSGSGTEFTLTISSLQPEDFATYYCLQHNSYPFTFGPGTKVEIKR

SEQ ID NO: 5795 - DNA, 18 bp, Artificial Sequence
  synthetic
cagggcattaataattat

SEQ ID NO: 5796 - protein, 6 aa, Artificial Sequence
  synthetic
QGINNY

SEQ ID NO: 5797 - DNA, 9 bp, Artificial Sequence
  synthetic
gctgcatcc

SEQ ID NO: 5798 - protein, 3 aa, Artificial Sequence
  synthetic
AAS

SEQ ID NO: 5799 - DNA, 27 bp, Artificial Sequence
  synthetic
ctacagcataatagttacccattcact

SEQ ID NO: 5800 - protein, 9 aa, Artificial Sequence
  synthetic
LQHNSYPFT

SEQ ID NO: 5801 - DNA, 366 bp, Artificial Sequence
  synthetic
caggtgcagctggtgcagtggggcgcaggactgttgaagccctcggagaccctgtccctcacctgcggtgtctatggtgggtccttcaattattactactggagttggatccgccagcccccagggaagggactggagtggattggggaaatcaatcatactggaagcaccaactacaacccgtccctcaagagtcgagtcaccatagaagtagacacgtccaagaaccagttctccctgaggttgaactctgtgaccgccgcggacacggctgtatattactgtgcgagaggcccctatacagtgactacggactactacggtttggacgtctggggccaagggaccacggtcaccgtctcctca

SEQ ID NO: 5802 - protein, 122 aa, Artificial Sequence
  synthetic
QVQLVQWGAGLLKPSETLSLTCGVYGGSFNYYYWSWIRQPPGKGLEWIGEINHTGSTNYNPSLKSRVTIEVDTSKNQFSLRLNSVTAADTAVYYCARGPYTVTTDYYGLDVWGQGTTVTVSS

SEQ ID NO: 5803 - DNA, 24 bp, Artificial Sequence
  synthetic
ggtgggtccttcaattattactac

SEQ ID NO: 5804 - protein, 8 aa, Artificial Sequence
  synthetic
GGSFNYYY

SEQ ID NO: 5805 - DNA, 21 bp, Artificial Sequence
  synthetic
atcaatcatactggaagcacc

SEQ ID NO: 5806 - protein, 7 aa, Artificial Sequence
  synthetic
INHTGST

SEQ ID NO: 5807 - DNA, 48 bp, Artificial Sequence
  synthetic
gcgagaggcccctatacagtgactacggactactacggtttggacgtc

SEQ ID NO: 5808 - protein, 16 aa, Artificial Sequence
  synthetic
ARGPYTVTTDYYGLDV

SEQ ID NO: 5809 - DNA, 327 bp, Artificial Sequence
  synthetic
gacatcgtgatgacccagtctccaggcaccctgtccttgtcgccaggggaaagagtcaccctctcctgcagggccagtcagagtgttagtagcaggtacttagcctggtaccggcagaaacctggccaggctcccaggctcctcatctatgacacatccatcagggccaccggcatcccagacaggttcagtggcagtgggtctgggacagacttcactctcaccatcagcagactggagcctgaagattttgcagtgtattactgtcagcagtttggtggttcaccgcacacttttggccaggggaccaaggtggagatcaaacga

SEQ ID NO: 5810 - protein, 109 aa, Artificial Sequence
  synthetic
DIVMTQSPGTLSLSPGERVTLSCRASQSVSSRYLAWYRQKPGQAPRLLIYDTSIRATGIPDRFSGSGSGTDFTLTISRLEPEDFAVYYCQQFGGSPHTFGQGTKVEIKR

SEQ ID NO: 5811 - DNA, 21 bp, Artificial Sequence
  synthetic
cagagtgttagtagcaggtac

SEQ ID NO: 5812 - protein, 7 aa, Artificial Sequence
  synthetic
QSVSSRY

SEQ ID NO: 5813 - DNA, 9 bp, Artificial Sequence
  synthetic
gacacatcc

SEQ ID NO: 5814 - protein, 3 aa, Artificial Sequence
  synthetic
DTS

SEQ ID NO: 5815 - DNA, 27 bp, Artificial Sequence
  synthetic
cagcagtttggtggttcaccgcacact

SEQ ID NO: 5816 - protein, 9 aa, Artificial Sequence
  synthetic
QQFGGSPHT

SEQ ID NO: 5817 - DNA, 387 bp, Artificial Sequence
  synthetic
gaggtgcagctggtggagtctggggctgcggtgaagaagcctggggcctcagtgaaggtctcctgcaaggtttccggatacaccctcactgaattgtccatacactgggtgcgacaggctcctggaaaagggcttgagtggatgggaagttttgatcctgaagatggtgaaacaatctacgcacagaagttccagggcagagtcaccatgaccgaggacacatctacagacacaacctacatggaactgaacagcctcagaactgaggacacggccgtatattactgtgcaacagcccaacgtggatatgttggctacgggacatcttactactacttctactctatggacgtctggggccaagggaccatggtcaccgtctcctca

SEQ ID NO: 5818 - protein, 129 aa, Artificial Sequence
  synthetic
EVQLVESGAAVKKPGASVKVSCKVSGYTLTELSIHWVRQAPGKGLEWMGSFDPEDGETIYAQKFQGRVTMTEDTSTDTTYMELNSLRTEDTAVYYCATAQRGYVGYGTSYYYFYSMDVWGQGTMVTVSS

SEQ ID NO: 5819 - DNA, 24 bp, Artificial Sequence
  synthetic
ggatacaccctcactgaattgtcc

SEQ ID NO: 5820 - protein, 8 aa, Artificial Sequence
  synthetic
GYTLTELS

SEQ ID NO: 5821 - DNA, 24 bp, Artificial Sequence
  synthetic
tttgatcctgaagatggtgaaaca

SEQ ID NO: 5822 - protein, 8 aa, Artificial Sequence
  synthetic
FDPEDGET

SEQ ID NO: 5823 - DNA, 66 bp, Artificial Sequence
  synthetic
gcaacagcccaacgtggatatgttggctacgggacatcttactactacttctactctatggacgtc

SEQ ID NO: 5824 - protein, 22 aa, Artificial Sequence
  synthetic
ATAQRGYVGYGTSYYYFYSMDV

SEQ ID NO: 5825 - DNA, 324 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcaatggatctggcacagatttcactctcaccatcagcagcctgcagcctgaagattttgcaacttattactgtctacaagattacaattacccgtggacgttcggccaagggaccaaggtggagatcaaacga

SEQ ID NO: 5826 - protein, 108 aa, Artificial Sequence
  synthetic
DIQMTQSPSSLSASVGDRVTITCRASQGIRNDLGWYQQKPGKAPKLLIYAASSLQSGVPSRFSGNGSGTDFTLTISSLQPEDFATYYCLQDYNYPWTFGQGTKVEIKR

SEQ ID NO: 5827 - DNA, 18 bp, Artificial Sequence
  synthetic
cagggcattagaaatgat

SEQ ID NO: 5828 - protein, 6 aa, Artificial Sequence
  synthetic
QGIRND

SEQ ID NO: 5829 - DNA, 9 bp, Artificial Sequence
  synthetic
gctgcatcc

SEQ ID NO: 5830 - protein, 3 aa, Artificial Sequence
  synthetic
AAS

SEQ ID NO: 5831 - DNA, 27 bp, Artificial Sequence
  synthetic
ctacaagattacaattacccgtggacg

SEQ ID NO: 5832 - protein, 9 aa, Artificial Sequence
  synthetic
LQDYNYPWT

SEQ ID NO: 5833 - DNA, 354 bp, Artificial Sequence
  synthetic
gaggtgcagctggtggagtctgggggaggcgtggtccagcctgggaggtccctgagactctcctgtgcagcgtctggattcaccttcagtagctatggcatgcactgggtccgccaggctccaggcaaggggctggagtggttggcagttatatggtttgatggaagtaataaatactatgcagactccgtgaagggccgattcaccatctccagagacaattccaagaacacgctgtatctgcaaatgaacagcctgagagccgaggacacggctgtgtattactgtgcgagagagatagcagctcgtccttttgactactggggccagggaaccctggtcaccgtctcctca

SEQ ID NO: 5834 - protein, 118 aa, Artificial Sequence
  synthetic
EVQLVESGGGVVQPGRSLRLSCAASGFTFSSYGMHWVRQAPGKGLEWLAVIWFDGSNKYYADSVKGRFTISRDNSKNTLYLQMNSLRAEDTAVYYCAREIAARPFDYWGQGTLVTVSS

SEQ ID NO: 5835 - DNA, 24 bp, Artificial Sequence
  synthetic
ggattcaccttcagtagctatggc

SEQ ID NO: 5836 - protein, 8 aa, Artificial Sequence
  synthetic
GFTFSSYG

SEQ ID NO: 5837 - DNA, 24 bp, Artificial Sequence
  synthetic
atatggtttgatggaagtaataaa

SEQ ID NO: 5838 - protein, 8 aa, Artificial Sequence
  synthetic
IWFDGSNK

SEQ ID NO: 5839 - DNA, 33 bp, Artificial Sequence
  synthetic
gcgagagagatagcagctcgtccttttgactac

SEQ ID NO: 5840 - protein, 11 aa, Artificial Sequence
  synthetic
AREIAARPFDY

SEQ ID NO: 5841 - DNA, 339 bp, Artificial Sequence
  synthetic
gacatcgtgatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaagctccctacacttttggccaggggaccaaggtggagatcaaacga

SEQ ID NO: 5842 - protein, 113 aa, Artificial Sequence
  synthetic
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQAPYTFGQGTKVEIKR

SEQ ID NO: 5843 - DNA, 33 bp, Artificial Sequence; identical to SEQ ID NO: 2259
  synthetic

SEQ ID NO: 5844 - protein, 11 aa, Artificial Sequence
  synthetic
QSLLHSNGYNY

SEQ ID NO: 5845 - DNA, 9 bp, Artificial Sequence
  synthetic
ttgggttct

SEQ ID NO: 5846 - protein, 3 aa, Artificial Sequence
  synthetic
LGS

SEQ ID NO: 5847 - DNA, 27 bp, Artificial Sequence
  synthetic
atgcaagctctacaagctccctacact

SEQ ID NO: 5848 - protein, 9 aa, Artificial Sequence
  synthetic
MQALQAPYT

SEQ ID NO: 5849 - DNA, 366 bp, Artificial Sequence
  synthetic
caggtgcagctggtgcagtggggcgcaggactgttgaagccttcggagaccctgtccctcacctgcgttgtctctggtgggtccttccgtctttactactggacctggatccgccagcccccagggaaggggctggagtggattggggaaatcaatcatactgggagcaacaactacaacccgtccctcaagagtcgagtcaccatatcagtagacacgtccaagaaccacttctccctgaagctgaattctgtgaccgccgcggacacggctgtgtattactgtgcgagaggcccctattcagtgactacggactactacggtttggacgtctggggccaagggaccatggtcaccgtctcctca

SEQ ID NO: 5850 - protein, 122 aa, Artificial Sequence
  synthetic
QVQLVQWGAGLLKPSETLSLTCVVSGGSFRLYYWTWIRQPPGKGLEWIGEINHTGSNNYNPSLKSRVTISVDTSKNHFSLKLNSVTAADTAVYYCARGPYSVTTDYYGLDVWGQGTMVTVSS

SEQ ID NO: 5851 - DNA, 24 bp, Artificial Sequence
  synthetic
ggtgggtccttccgtctttactac

SEQ ID NO: 5852 - protein, 8 aa, Artificial Sequence
  synthetic
GGSFRLYY

SEQ ID NO: 5853 - DNA, 21 bp, Artificial Sequence
  synthetic
atcaatcatactgggagcaac

SEQ ID NO: 5854 - protein, 7 aa, Artificial Sequence
  synthetic
INHTGSN

SEQ ID NO: 5855 - DNA, 48 bp, Artificial Sequence
  synthetic
gcgagaggcccctattcagtgactacggactactacggtttggacgtc

SEQ ID NO: 5856 - protein, 16 aa, Artificial Sequence
  synthetic
ARGPYSVTTDYYGLDV

SEQ ID NO: 5857 - DNA, 327 bp, Artificial Sequence
  synthetic
gacatcgtgatgacccagtctccaggcaccctgtctttgtctccgggggaaagagccaccctctcctgcagggccagtcagagttttaacagcgactacttagcctggtaccagcagaaacctggccagactcccaggctcctcatctatggtacgtccaccagggccactggcatcccagacaggttcagtggcagtgggtctgggacagacttcactctcaccatcaggagactggagcctgaagattttgcagtgtattactgtcaccagtatggtagtttgccgctcacattcggcggagggaccaaggtggagatcaaacga

SEQ ID NO: 5858 - protein, 109 aa, Artificial Sequence
  synthetic
DIVMTQSPGTLSLSPGERATLSCRASQSFNSDYLAWYQQKPGQTPRLLIYGTSTRATGIPDRFSGSGSGTDFTLTIRRLEPEDFAVYYCHQYGSLPLTFGGGTKVEIKR

SEQ ID NO: 5859 - DNA, 21 bp, Artificial Sequence
  synthetic
cagagttttaacagcgactac

SEQ ID NO: 5860 - protein, 7 aa, Artificial Sequence
  synthetic
QSFNSDY

SEQ ID NO: 5861 - DNA, 9 bp, Artificial Sequence
  synthetic
ggtacgtcc

SEQ ID NO: 5862 - protein, 3 aa, Artificial Sequence
  synthetic
GTS

SEQ ID NO: 5863 - DNA, 27 bp, Artificial Sequence
  synthetic
caccagtatggtagtttgccgctcaca

SEQ ID NO: 5864 - protein, 9 aa, Artificial Sequence
  synthetic
HQYGSLPLT

SEQ ID NO: 5865 - DNA, 378 bp, Artificial Sequence
  synthetic
caggtgcagctggtggagtctgggggaggcgtggtccagcctgggaggtccctgagactctcctgtgcagcgtctggattcaccttcagtacctatggcatgcactgggtccgccaggctccaggcaaggggccggagtgggtggcacttatttggtatgatggaattaataaatatcatggagagtccgtgaagggccgattcaccatctccagagacaattccaagaacacgctgtatctgcaaatgaacagcctgagagtcgaggacacggctgtgtattactgtgcgagagatcgggacgtgtttcgcagttcgtatcactcctattacggtatggatgtctggggccaagggaccacggtcaccgtctcctca

SEQ ID NO: 5866 - protein, 126 aa, Artificial Sequence
  synthetic
QVQLVESGGGVVQPGRSLRLSCAASGFTFSTYGMHWVRQAPGKGPEWVALIWYDGINKYHGESVKGRFTISRDNSKNTLYLQMNSLRVEDTAVYYCARDRDVFRSSYHSYYGMDVWGQGTTVTVSS

SEQ ID NO: 5867 - DNA, 24 bp, Artificial Sequence
  synthetic
ggattcaccttcagtacctatggc

SEQ ID NO: 5868 - protein, 8 aa, Artificial Sequence
  synthetic
GFTFSTYG

SEQ ID NO: 5869 - DNA, 24 bp, Artificial Sequence
  synthetic
atttggtatgatggaattaataaa

SEQ ID NO: 5870 - protein, 8 aa, Artificial Sequence
  synthetic
IWYDGINK

SEQ ID NO: 5871 - DNA, 57 bp, Artificial Sequence
  synthetic
gcgagagatcgggacgtgtttcgcagttcgtatcactcctattacggtatggatgtc

SEQ ID NO: 5872 - protein, 19 aa, Artificial Sequence
  synthetic
ARDRDVFRSSYHSYYGMDV

SEQ ID NO: 5873 - DNA, 336 bp, Artificial Sequence
  synthetic
gacatcgtgatgacccagtctccactctccctgcccgtcacccctggagagccggcctccatctcctgcaggtctagtcagagcctcctgcatggtaatggacacaactatttggattggtacatgcagaagtcagggcagtctccacaggtcctgatctatttgggttctaagcgggcctccggggtccctgacaggttcagtggcagtggatcaggcacagattttacattgaaaatcagcagagtggaggctgaggatgttgggatttattactgcatgcaagctctacaaactcccactttcggcggagggaccaaggtggagatcaaacga

SEQ ID NO: 5874 - protein, 112 aa, Artificial Sequence
  synthetic
DIVMTQSPLSLPVTPGEPASISCRSSQSLLHGNGHNYLDWYMQKSGQSPQVLIYLGSKRASGVPDRFSGSGSGTDFTLKISRVEAEDVGIYYCMQALQTPTFGGGTKVEIKR

SEQ ID NO: 5875 - DNA, 33 bp, Artificial Sequence
  synthetic
cagagcctcctgcatggtaatggacacaactat

SEQ ID NO: 5876 - protein, 11 aa, Artificial Sequence
  synthetic
QSLLHGNGHNY

SEQ ID NO: 5877 - DNA, 9 bp, Artificial Sequence
  synthetic
ttgggttct

SEQ ID NO: 5878 - protein, 3 aa, Artificial Sequence
  synthetic
LGS

SEQ ID NO: 5879 - DNA, 24 bp, Artificial Sequence
  synthetic
atgcaagctctacaaactcccact

SEQ ID NO: 5880 - protein, 8 aa, Artificial Sequence
  synthetic
MQALQTPT

SEQ ID NO: 5881 - DNA, 387 bp, Artificial Sequence
  synthetic
gaggtgcagctggtggagtctggggctgcggtgaagaagcctggggcctcagtgaaggtctcctgcaaggtttccggatacaccctcactgaattgtccatacactgggtgcgacaggctcctggaaaagggcttgagtggatgggaagttttgatcctgaagatggtgaaacaatctacgcacagaagttccagggcagagtcaccatgaccgaggacacatctacagacacaacctacatggaactgaacagcctcagaactgaggacacggccgtatattactgtgcaacagcccaacgtggatatgttggctacgggacatcttactactacttctactctatggacgtctggggccaagggaccacggtcaccgtctcctca

SEQ ID NO: 5882 - protein, 129 aa, Artificial Sequence
  synthetic
EVQLVESGAAVKKPGASVKVSCKVSGYTLTELSIHWVRQAPGKGLEWMGSFDPEDGETIYAQKFQGRVTMTEDTSTDTTYMELNSLRTEDTAVYYCATAQRGYVGYGTSYYYFYSMDVWGQGTTVTVSS

SEQ ID NO: 5883 - DNA, 24 bp, Artificial Sequence
  synthetic
ggatacaccctcactgaattgtcc

SEQ ID NO: 5884 - protein, 8 aa, Artificial Sequence
  synthetic
GYTLTELS

SEQ ID NO: 5885 - DNA, 24 bp, Artificial Sequence
  synthetic
tttgatcctgaagatggtgaaaca

SEQ ID NO: 5886 - protein, 8 aa, Artificial Sequence
  synthetic
FDPEDGET

SEQ ID NO: 5887 - DNA, 66 bp, Artificial Sequence; identical to SEQ ID NO: 5823
  synthetic

SEQ ID NO: 5888 - protein, 22 aa, Artificial Sequence
  synthetic
ATAQRGYVGYGTSYYYFYSMDV

SEQ ID NO: 5889 - DNA, 324 bp, Artificial Sequence
  synthetic
gacatcctgatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcaatggatctggcacagatttcactctcaccatcagcagcctgcagcctgaagattttgcaacttattactgtctacaagattacaattacccgtggacgttcggccaagggaccaaggtggagatcaaacga

SEQ ID NO: 5890 - protein, 108 aa, Artificial Sequence
  synthetic
DILMTQSPSSLSASVGDRVTITCRASQGIRNDLGWYQQKPGKAPKLLIYAASSLQSGVPSRFSGNGSGTDFTLTISSLQPEDFATYYCLQDYNYPWTFGQGTKVEIKR

SEQ ID NO: 5891 - DNA, 18 bp, Artificial Sequence
  synthetic
cagggcattagaaatgat

SEQ ID NO: 5892 - protein, 6 aa, Artificial Sequence
  synthetic
QGIRND

SEQ ID NO: 5893 - DNA, 9 bp, Artificial Sequence
  synthetic
gctgcatcc

SEQ ID NO: 5894 - protein, 3 aa, Artificial Sequence
  synthetic
AAS

SEQ ID NO: 5895 - DNA, 27 bp, Artificial Sequence
  synthetic
ctacaagattacaattacccgtggacg

SEQ ID NO: 5896 - protein, 9 aa, Artificial Sequence
  synthetic
LQDYNYPWT

SEQ ID NO: 5897 - DNA, 366 bp, Artificial Sequence
  synthetic
caggtgcagctggtgcagtggggcgcaggactgttgaagccttcggagaccctgtccctcacctgcgctgtctatggtgggtccttcaatatttactactggacctggatccgccagcccccagggaaggggctggagtggattggggaaatcaatcatactggaagcaccaactacatcccgtccctcaagagtcgagtcagcatatcagtagacacgtccaagaaccagttctcccttaaactgacctctgtgaccgccgcggacacggctgtgtattactgtgcgagaggcccctatacactaacaacggactattacggtttggacgtctggggccaagggaccacggtcaccgtctcctca

SEQ ID NO: 5898 - protein, 122 aa, Artificial Sequence
  synthetic
QVQLVQWGAGLLKPSETLSLTCAVYGGSFNIYYWTWIRQPPGKGLEWIGEINHTGSTNYIPSLKSRVSISVDTSKNQFSLKLTSVTAADTAVYYCARGPYTLTTDYYGLDVWGQGTTVTVSS

SEQ ID NO: 5899 - DNA, 24 bp, Artificial Sequence
  synthetic
ggtgggtccttcaatatttactac

SEQ ID NO: 5900 - protein, 8 aa, Artificial Sequence
  synthetic
GGSFNIYY

SEQ ID NO: 5901 - DNA, 21 bp, Artificial Sequence
  synthetic
atcaatcatactggaagcacc

SEQ ID NO: 5902 - protein, 7 aa, Artificial Sequence
  synthetic
INHTGST

SEQ ID NO: 5903 - DNA, 48 bp, Artificial Sequence
  synthetic
gcgagaggcccctatacactaacaacggactattacggtttggacgtc

SEQ ID NO: 5904 - protein, 16 aa, Artificial Sequence
  synthetic
ARGPYTLTTDYYGLDV

SEQ ID NO: 5905 - DNA, 327 bp, Artificial Sequence
  synthetic
gacatccagatgacccagtctccagacaccctgtctttgtctccaggggaaagagccaccctctcctgcagggccagtcagagtattagcagcgactacttagcctggtaccaacaaaaaactggccaggctcccaggctcctcatctatggtgcatccagcagggccactggcatcccagacaggttcagtggcagtgggtctgagacagacttcactctcaacatcagcagactggaggctgaagattttgcagtgtattactgtcagcagtatggtggctcaccgtccacttttggccaggggaccaaggtggagatcaaacga

SEQ ID NO: 5906 - protein, 109 aa, Artificial Sequence
  synthetic
DIQMTQSPDTLSLSPGERATLSCRASQSISSDYLAWYQQKTGQAPRLLIYGASSRATGIPDRFSGSGSETDFTLNISRLEAEDFAVYYCQQYGGSPSTFGQGTKVEIKR

SEQ ID NO: 5907 - DNA, 21 bp, Artificial Sequence
  synthetic
cagagtattagcagcgactac

SEQ ID NO: 5908 - protein, 7 aa, Artificial Sequence
  synthetic
QSISSDY

SEQ ID NO: 5909 - DNA, 9 bp, Artificial Sequence
  synthetic
ggtgcatcc

SEQ ID NO: 5910 - protein, 3 aa, Artificial Sequence
  synthetic
GAS

SEQ ID NO: 5911 - DNA, 27 bp, Artificial Sequence
  synthetic
cagcagtatggtggctcaccgtccact

SEQ ID NO: 5912 - protein, 9 aa, Artificial Sequence
  synthetic
QQYGGSPST

SEQ ID NO: 5913 - DNA, 369 bp, Artificial Sequence
  synthetic
gaggtgcagctggtggagtctgggggaggcttggtacagcctggcaggtccctgagactctcctgtggcgtctctggattcacctttgatgatcatgccatgcactgggtccggcaagctccagggaagggcctggagtgggtcgcaggtattagttggaatagtggtagcatgggctatgcggactctgtgaagggccgattcaccatctccagagacaacgccaagaactccctctatctgcaaatgaacagtctgagacctgaagacacggccttgtattactgtgcaagagatatagcagcagctggactccattactacggtatggacgtctggggccaagggaccacggtcaccgtctcctca

SEQ ID NO: 5914 - protein, 123 aa, Artificial Sequence
  synthetic
EVQLVESGGGLVQPGRSLRLSCGVSGFTFDDHAMHWVRQAPGKGLEWVAGISWNSGSMGYADSVKGRFTISRDNAKNSLYLQMNSLRPEDTALYYCARDIAAAGLHYYGMDVWGQGTTVTVSS

SEQ ID NO: 5915 - DNA, 24 bp, Artificial Sequence
  synthetic
ggattcacctttgatgatcatgcc

SEQ ID NO: 5916 - protein, 8 aa, Artificial Sequence
  synthetic
GFTFDDHA

SEQ ID NO: 5917 - DNA, 24 bp, Artificial Sequence
  synthetic
attagttggaatagtggtagcatg

SEQ ID NO: 5918 - protein, 8 aa, Artificial Sequence
  synthetic
ISWNSGSM

SEQ ID NO: 5919 - DNA, 48 bp, Artificial Sequence
  synthetic
gcaagagatatagcagcagctggactccattactacggtatggacgtc

SEQ ID NO: 5920 - protein, 16 aa, Artificial Sequence
  synthetic
ARDIAAAGLHYYGMDV

SEQ ID NO: 5921 - DNA, 324 bp, Artificial Sequence
  synthetic
gacatcgtgatgacccagtctccatcctccctgtctgcatctgtagaagacagagtcaccatcacttgccgggcaagtcaggacattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaatttattactgtctacagtataatagttacccattcactttcggccctgggaccaaggtggagatcaaacga

SEQ ID NO: 5922 - protein, 108 aa, Artificial Sequence
  synthetic
DIVMTQSPSSLSASVEDRVTITCRASQDIRNDLGWYQQKPGKAPKRLIYAASSLQSGVPSRFSGSGSGTEFTLTISSLQPEDFAIYYCLQYNSYPFTFGPGTKVEIKR

SEQ ID NO: 5923 - DNA, 18 bp, Artificial Sequence
  synthetic
caggacattagaaatgat

SEQ ID NO: 5924 - protein, 6 aa, Artificial Sequence
  synthetic
QDIRND

SEQ ID NO: 5925 - DNA, 9 bp, Artificial Sequence
  synthetic
gctgcatcc

SEQ ID NO: 5926 - protein, 3 aa, Artificial Sequence
  synthetic
AAS

SEQ ID NO: 5927 - DNA, 27 bp, Artificial Sequence
  synthetic
ctacagtataatagttacccattcact

SEQ ID NO: 5928 - protein, 9 aa, Artificial Sequence
  synthetic
LQYNSYPFT

SEQ ID NO: 5929 - DNA, 378 bp, Artificial Sequence
  synthetic
gaggtgcagctggtggagtctgggggaggcgtggtccagcctgggaggtccctgagactctcctgtgcagcgtctggattcaccttcagtagctatggcatgcactgggtccgccaggctccaggcaaggggccggagtgggtggcaattatttggtatgatggaattaataaatatcatggagactccgtgaagggccgattcaccatctccagagacaattccaagaacacgctgtatctgcaaatgaacagcctgagagtcgaggacacggctgtgtattactgtgcgagagatcgggacgtgtttcgcagttcgtattattcctattacggtatggatgtctggggccaagggaccacggtcaccgtctcctca

SEQ ID NO: 5930 - protein, 126 aa, Artificial Sequence
  synthetic
EVQLVESGGGVVQPGRSLRLSCAASGFTFSSYGMHWVRQAPGKGPEWVAIIWYDGINKYHGDSVKGRFTISRDNSKNTLYLQMNSLRVEDTAVYYCARDRDVFRSSYYSYYGMDVWGQGTTVTVSS

SEQ ID NO: 5931 - DNA, 24 bp, Artificial Sequence
  synthetic
ggattcaccttcagtagctatggc

SEQ ID NO: 5932 - protein, 8 aa, Artificial Sequence
  synthetic
GFTFSSYG

SEQ ID NO: 5933 - DNA, 24 bp, Artificial Sequence
  synthetic
atttggtatgatggaattaataaa

SEQ ID NO: 5934 - protein, 8 aa, Artificial Sequence
  synthetic
IWYDGINK

SEQ ID NO: 5935 - DNA, 57 bp, Artificial Sequence
  synthetic
gcgagagatcgggacgtgtttcgcagttcgtattattcctattacggtatggatgtc

SEQ ID NO: 5936 - protein, 19 aa, Artificial Sequence
  synthetic
ARDRDVFRSSYYSYYGMDV

SEQ ID NO: 5937 - DNA, 336 bp, Artificial Sequence
  synthetic
gacatcgtgatgacccagtctccactctccctgcccgtcacccctggagagccggcctccatctcctgcaggtctagtcagagcctcctacatggtaatggacacaactatttggattggtacatgcagaagtcagggcagtctccacaggtcctgatctatttgggttctaagcgggcctccggggtccctgacaggttcagtggcagtggatcaggcacagattttacattgaaaatcagcacagtggaggctgaggatgttgggatttattactgcatgcaagctctacaaactcccactttcggcggagggaccaaggtggagatcaaacga

SEQ ID NO: 5938 - protein, 112 aa, Artificial Sequence
  synthetic
DIVMTQSPLSLPVTPGEPASISCRSSQSLLHGNGHNYLDWYMQKSGQSPQVLIYLGSKRASGVPDRFSGSGSGTDFTLKISTVEAEDVGIYYCMQALQTPTFGGGTKVEIKR

SEQ ID NO: 5939 - DNA, 33 bp, Artificial Sequence
  synthetic
cagagcctcctacatggtaatggacacaactat

SEQ ID NO: 5940 - protein, 11 aa, Artificial Sequence
  synthetic
QSLLHGNGHNY

SEQ ID NO: 5941 - DNA, 9 bp, Artificial Sequence
  synthetic
ttgggttct

SEQ ID NO: 5942 - protein, 3 aa, Artificial Sequence
  synthetic
LGS

SEQ ID NO: 5943 - DNA, 24 bp, Artificial Sequence
  synthetic
atgcaagctctacaaactcccact

SEQ ID NO: 5944 - protein, 8 aa, Artificial Sequence
  synthetic
MQALQTPT

SEQ ID NO: 5945 - DNA, 357 bp, Artificial Sequence
  synthetic
caggtgcagctggtgcagtggggcgcaggactgttgaagccttcggagaccctgtccctcacctgcgctgtcaatggtgggtccttcagtggttacttctggagctggatccgccagcccccagggaaggggctggagtggattggggaaatcattcaaagtggaaccatcacctacaacccgtccctcaagagtcgagtcaccatatcgatagacacgtccactaaccagttctccctgaagctgacctctgtgaccgccgcggacacggctgtgtattactgtgcggggaataagtggaactacgagaggtggttcgacccctggggccagggaaccatggtcaccgtctcctca

SEQ ID NO: 5946 - protein, 119 aa, Artificial Sequence
  synthetic
QVQLVQWGAGLLKPSETLSLTCAVNGGSFSGYFWSWIRQPPGKGLEWIGEIIQSGTITYNPSLKSRVTISIDTSTNQFSLKLTSVTAADTAVYYCAGNKWNYERWFDPWGQGTMVTVSS

SEQ ID NO: 5947 - DNA, 24 bp, Artificial Sequence
  synthetic
ggtgggtccttcagtggttacttc

SEQ ID NO: 5948 - protein, 8 aa, Artificial Sequence
  synthetic
GGSFSGYF

SEQ ID NO: 5949 - DNA, 21 bp, Artificial Sequence
  synthetic
atcattcaaagtggaaccatc

SEQ ID NO: 5950 - protein, 7 aa, Artificial Sequence
  synthetic
IIQSGTI

SEQ ID NO: 5951 - DNA, 39 bp, Artificial Sequence
  synthetic
gcggggaataagtggaactacgagaggtggttcgacccc

SEQ ID NO: 5952 - protein, 13 aa, Artificial Sequence
  synthetic
AGNKWNYERWFDP

SEQ ID NO: 5953 - DNA, 321 bp, Artificial Sequence
  synthetic
gacatcgtgatgacccagtctccagccaccctgtctgtgtctccaggggaaagagccaccctctcctgtagggccagtcagagtgttagaagcaacttagcctggtaccagcagaaacctggccaggctcccaggctcctcatctatggtatatttaccagggccactaatatcccagccaggttcagtggtggtgggtctgggacagagttcactctcaccatcagcagcctgcagtctgaagactttgcagtttattactgtcagcagtatcataactggatcaccttcggccaagggacacgactggagattaaacga

SEQ ID NO: 5954 - protein, 107 aa, Artificial Sequence
  synthetic
DIVMTQSPATLSVSPGERATLSCRASQSVRSNLAWYQQKPGQAPRLLIYGIFTRATNIPARFSGGGSGTEFTLTISSLQSEDFAVYYCQQYHNWITFGQGTRLEIKR

SEQ ID NO: 5955 - DNA, 18 bp, Artificial Sequence
  synthetic
cagagtgttagaagcaac

SEQ ID NO: 5956 - protein, 6 aa, Artificial Sequence
  synthetic
QSVRSN

SEQ ID NO: 5957 - DNA, 9 bp, Artificial Sequence
  synthetic
ggtatattt

SEQ ID NO: 5958 - protein, 3 aa, Artificial Sequence
  synthetic
GIF

SEQ ID NO: 5959 - DNA, 24 bp, Artificial Sequence
  synthetic
cagcagtatcataactggatcacc

SEQ ID NO: 5960 - protein, 8 aa, Artificial Sequence
  synthetic
QQYHNWIT

SEQ ID NO: 5961 - DNA, 354 bp, Artificial Sequence
  synthetic
gaggtgcagctggtggagtctgggggaggcgtggtccagcctgggaagtccctgagactctcctgtgcagcgtctggattcaccttcagtacctatggcatgcactgggtccgccaggctccaggcaagggactggagtgggtggcatctatatggtatgatggaaccaataaaaactatgtaaactccgtgtggggccgattcaccatctccagagacaactccaagaacacgctgtatttgcaaatgaacagcctgagagccgaggacacggctgtgtattactgtgcgacagaaatcgcagctcgtccctttgagtattggggccagggaaccctggtcaccgtctcctca

SEQ ID NO: 5962 - protein, 118 aa, Artificial Sequence
  synthetic
EVQLVESGGGVVQPGKSLRLSCAASGFTFSTYGMHWVRQAPGKGLEWVASIWYDGTNKNYVNSVWGRFTISRDNSKNTLYLQMNSLRAEDTAVYYCATEIAARPFEYWGQGTLVTVSS

SEQ ID NO: 5963 - DNA, 24 bp, Artificial Sequence
  synthetic
ggattcaccttcagtacctatggc

SEQ ID NO: 5964 - protein, 8 aa, Artificial Sequence
  synthetic
GFTFSTYG

SEQ ID NO: 5965 - DNA, 24 bp, Artificial Sequence
  synthetic
atatggtatgatggaaccaataaa

SEQ ID NO: 5966 - protein, 8 aa, Artificial Sequence
  synthetic
IWYDGTNK

SEQ ID NO: 5967 - DNA, 33 bp, Artificial Sequence
  synthetic
gcgacagaaatcgcagctcgtccctttgagtat

SEQ ID NO: 5968 - protein, 11 aa, Artificial Sequence
  synthetic
ATEIAARPFEY

SEQ ID NO: 5969 - DNA, 339 bp, Artificial Sequence
  synthetic
gacatcgtgatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttttaatcgggcctccggggtccctgacaggttcagtggcagtgtctcaggcacagattttacactgaaaatcagcagagtggaggctgaggatgttgggatttattactgcatgcaagctctgcaaattccgtacacttttggccaggggaccaaggtggagatcaaacga

SEQ ID NO: 5970 - protein, 113 aa, Artificial Sequence
  synthetic
DIVMTQSPLSLPVTPGEPASISCRSSQSLLHSNGYNYLDWYLQKPGQSPQLLIYLGFNRASGVPDRFSGSVSGTDFTLKISRVEAEDVGIYYCMQALQIPYTFGQGTKVEIKR

SEQ ID NO: 5971 - DNA, 33 bp, Artificial Sequence; identical to SEQ ID NO: 2259
  synthetic

SEQ ID NO: 5972 - protein, 11 aa, Artificial Sequence
  synthetic
QSLLHSNGYNY

SEQ ID NO: 5973 - DNA, 9 bp, Artificial Sequence
  synthetic
ttgggtttt

SEQ ID NO: 5974 - protein, 3 aa, Artificial Sequence
  synthetic
LGF

SEQ ID NO: 5975 - DNA, 27 bp, Artificial Sequence
  synthetic
atgcaagctctgcaaattccgtacact

SEQ ID NO: 5976 - protein, 9 aa, Artificial Sequence
  synthetic
MQALQIPYT

SEQ ID NO: 5977 - DNA, 369 bp, Artificial Sequence
  synthetic
gaggtgcagctggtggagtctgggggaggcttgtttcagcctgacaggtccctgagactctcctgtgcagcctctggattcacctttgatgattatgacatgcactgggtccggcaagctccagggaagggcctggaatgggtctcaggtattagttggaatagtgttaacaaagactgtgcggactctgtgaggggccgattcaccatctccagagacaacgccaagaactccctgtatctgcaaatgaacagtctgagaactgaggacacggccttctattactgtgcaaagagtgccttaactgtggatgccctctactggtatttcgatatctggggccgtggcaccctggtcaccgtctcctca

SEQ ID NO: 5978 - protein, 123 aa, Artificial Sequence
  synthetic
EVQLVESGGGLFQPDRSLRLSCAASGFTFDDYDMHWVRQAPGKGLEWVSGISWNSVNKDCADSVRGRFTISRDNAKNSLYLQMNSLRTEDTAFYYCAKSALTVDALYWYFDIWGRGTLVTVSS

SEQ ID NO: 5979 - DNA, 24 bp, Artificial Sequence
  synthetic
ggattcacctttgatgattatgac

SEQ ID NO: 5980 - protein, 8 aa, Artificial Sequence
  synthetic
GFTFDDYD

SEQ ID NO: 5981 - DNA, 24 bp, Artificial Sequence
  synthetic
attagttggaatagtgttaacaaa

SEQ ID NO: 5982 - protein, 8 aa, Artificial Sequence
  synthetic
ISWNSVNK

SEQ ID NO: 5983 - DNA, 48 bp, Artificial Sequence
  synthetic
gcaaagagtgccttaactgtggatgccctctactggtatttcgatatc

SEQ ID NO: 5984 - protein, 16 aa, Artificial Sequence
  synthetic
AKSALTVDALYWYFDI

SEQ ID NO: 5985 - DNA, 327 bp, Artificial Sequence
  synthetic
gacatcgtgatgacccagtctccaggcaccctgtctttgtctccaggggaaagagtcaccctctcctgcagggccagtcagatttttggcagcagttacttagcctggtaccaactgaaacctggccaggctcccaggctcctcatctatggtgcatccagcagggccactggcatcccagacaggttcagtggcagtgggtctgggacagacttcactctcaccatcagcagcctggagcctgaagattttgcagtgtattactgtcagcactatggtagctcaccttacacttttggccaggggaccaaggtggagatcaaacga

SEQ ID NO: 5986 - protein, 109 aa, Artificial Sequence
  synthetic
DIVMTQSPGTLSLSPGERVTLSCRASQIFGSSYLAWYQLKPGQAPRLLIYGASSRATGIPDRFSGSGSGTDFTLTISSLEPEDFAVYYCQHYGSSPYTFGQGTKVEIKR

SEQ ID NO: 5987 - DNA, 21 bp, Artificial Sequence
  synthetic
cagatttttggcagcagttac

SEQ ID NO: 5988 - protein, 7 aa, Artificial Sequence
  synthetic
QIFGSSY

SEQ ID NO: 5989 - DNA, 9 bp, Artificial Sequence
  synthetic
ggtgcatcc

SEQ ID NO: 5990 - protein, 3 aa, Artificial Sequence
  synthetic
GAS

SEQ ID NO: 5991 - DNA, 27 bp, Artificial Sequence
  synthetic
cagcactatggtagctcaccttacact

SEQ ID NO: 5992 - protein, 9 aa, Artificial Sequence
  synthetic
QHYGSSPYT

SEQ ID NO: 5993 - DNA, 357 bp, Artificial Sequence
  synthetic
caggtgcagctggtggagtctggcgcaggactgttgaagccttcggagaccctgtccctcacctgcgctgtctatggtgggctcttcagtggttacttctggagctggatccgccagcccccagggaaggggctggagtggattggggaaatcattcaaagtggaagcatcacctacaacccgtctctcaagagtcgagtcaccatatcgatagacacgtccactaatcagttctccctgaagctgagctctgtgaccgccgcggacacggctgtgtattactgtgcgggaaataagtggaactacgagaggtggttcgacccctggggccagggaaccctggtcaccgtctcctca

SEQ ID NO: 5994 - protein, 119 aa, Artificial Sequence
  synthetic
QVQLVESGAGLLKPSETLSLTCAVYGGLFSGYFWSWIRQPPGKGLEWIGEIIQSGSITYNPSLKSRVTISIDTSTNQFSLKLSSVTAADTAVYYCAGNKWNYERWFDPWGQGTLVTVSS

SEQ ID NO: 5995 - DNA, 24 bp, Artificial Sequence
  synthetic
ggtgggctcttcagtggttacttc

SEQ ID NO: 5996 - protein, 8 aa, Artificial Sequence
  synthetic
GGLFSGYF

SEQ ID NO: 5997 - DNA, 21 bp, Artificial Sequence
  synthetic
atcattcaaagtggaagcatc

SEQ ID NO: 5998 - protein, 7 aa, Artificial Sequence
  synthetic
IIQSGSI

SEQ ID NO: 5999 - DNA, 39 bp, Artificial Sequence
  synthetic
gcgggaaataagtggaactacgagaggtggttcgacccc

SEQ ID NO: 6000 - protein, 13 aa, Artificial Sequence
  synthetic
AGNKWNYERWFDP

SEQ ID NO: 6001 - DNA, 321 bp, Artificial Sequence
  synthetic
gacattgtgatgacccagtctccagccaccctgtctgtgtctccaggggaaggagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtatcataactggatcaccttcggccaagggacacgactggagattaaacga

SEQ ID NO: 6002 - protein, 107 aa, Artificial Sequence
  synthetic
DIVMTQSPATLSVSPGEGATLSCRASQSVSSNLAWYQQKPGQAPRLLIYGASTRATGIPARFSGSGSGTEFTLTISSLQSEDFAVYYCQQYHNWITFGQGTRLEIKR

SEQ ID NO: 6003 - DNA, 18 bp, Artificial Sequence
  synthetic
cagagtgttagcagcaac

SEQ ID NO: 6004 - protein, 6 aa, Artificial Sequence
  synthetic
QSVSSN

SEQ ID NO: 6005 - DNA, 9 bp, Artificial Sequence
  synthetic
ggtgcatcc

SEQ ID NO: 6006 - protein, 3 aa, Artificial Sequence
  synthetic
GAS

SEQ ID NO: 6007 - DNA, 24 bp, Artificial Sequence
  synthetic
cagcagtatcataactggatcacc

SEQ ID NO: 6008 - protein, 8 aa, Artificial Sequence
  synthetic
QQYHNWIT

SEQ ID NO: 6009 - DNA, 366 bp, Artificial Sequence
  synthetic
caggtgcagctggtgcagtggggcgcaggactattgaagccttcggagaccctgtccctcacctccgctgtctataatgggtccttcactatttattattggacctggatccgccagcccccagggaaggggctggagtggattggggagatcaatcatactggaagtaccaactacaacccgtccctcaagagtcgagtcaccatatcagtagacacgcccaagaaccagttctctctgaaactaacctcagtgaccgccgcggacacggctgtttatttctgtgcgagaggcccctatacattaactacggactactacggtctggacgtctggggccaagggaccacggtcaccgtctcctca

SEQ ID NO: 6010 - protein, 122 aa, Artificial Sequence
  synthetic
QVQLVQWGAGLLKPSETLSLTSAVYNGSFTIYYWTWIRQPPGKGLEWIGEINHTGSTNYNPSLKSRVTISVDTPKNQFSLKLTSVTAADTAVYFCARGPYTLTTDYYGLDVWGQGTTVTVSS

SEQ ID NO: 6011 - DNA, 24 bp, Artificial Sequence
  synthetic
aatgggtccttcactatttattat

SEQ ID NO: 6012 - protein, 8 aa, Artificial Sequence
  synthetic
NGSFTIYY

SEQ ID NO: 6013 - DNA, 21 bp, Artificial Sequence
  synthetic
atcaatcatactggaagtacc

SEQ ID NO: 6014 - protein, 7 aa, Artificial Sequence
  synthetic
INHTGST

SEQ ID NO: 6015 - DNA, 48 bp, Artificial Sequence
  synthetic
gcgagaggcccctatacattaactacggactactacggtctggacgtc

SEQ ID NO: 6016 - protein, 16 aa, Artificial Sequence
  synthetic
ARGPYTLTTDYYGLDV

SEQ ID NO: 6017 - DNA, 327 bp, Artificial Sequence
  synthetic
gacatcgtgatgacccagtctccaggcaccctgtctttgtctccaggggaaagagccaccctctcctgcagggccagtcagagtgttagcagctactacttagcctggtaccagcagaaacctggccaggctcccaggctcctcatctatgatacatccaccagggccactggcatcccagacaggttcattggcagtgggtctgggacagacttcactctcaccatcagcagactggagcctgaagattttgcagtgtattactgtcaacagtttggtagttcaccgctcactttcggcggagggaccaaggtggagatcaaacga

SEQ ID NO: 6018 - protein, 109 aa, Artificial Sequence
  synthetic
DIVMTQSPGTLSLSPGERATLSCRASQSVSSYYLAWYQQKPGQAPRLLIYDTSTRATGIPDRFIGSGSGTDFTLTISRLEPEDFAVYYCQQFGSSPLTFGGGTKVEIKR

SEQ ID NO: 6019 - DNA, 21 bp, Artificial Sequence
  synthetic
cagagtgttagcagctactac

SEQ ID NO: 6020 - protein, 7 aa, Artificial Sequence
  synthetic
QSVSSYY

SEQ ID NO: 6021 - DNA, 9 bp, Artificial Sequence
  synthetic
gatacatcc

SEQ ID NO: 6022 - protein, 3 aa, Artificial Sequence
  synthetic
DTS

SEQ ID NO: 6023 - DNA, 27 bp, Artificial Sequence
  synthetic
caacagtttggtagttcaccgctcact

SEQ ID NO: 6024 - protein, 9 aa, Artificial Sequence
  synthetic
QQFGSSPLT

SEQ ID NO: 6025 - DNA, 366 bp, Artificial Sequence
  synthetic
caggtgcagctggtggagtctgggggaggcgtggtccagcctgggaggtccctgagactctcctgtacagcgtctggattcaccttcagtagctatggcatgcactgggtccgccaggctccaggcaaggggctggagtggatggcagatatatggtatgatggaagtaatacagactatgtagactccgtgaagggccgattcaccatctcaagagacaattccaagaacacgttgtatctccaaatgaacagcctgagagtcgaggacacggctgtttattactgtgcgagagatcggcatagtaacagctggttagactacttagaatattggggccagggaaccctggtcaccgtctcctca

SEQ ID NO: 6026 - protein, 122 aa, Artificial Sequence
  synthetic
QVQLVESGGGVVQPGRSLRLSCTASGFTFSSYGMHWVRQAPGKGLEWMADIWYDGSNTDYVDSVKGRFTISRDNSKNTLYLQMNSLRVEDTAVYYCARDRHSNSWLDYLEYWGQGTLVTVSS

SEQ ID NO: 6027 - DNA, 24 bp, Artificial Sequence
  synthetic
ggattcaccttcagtagctatggc

SEQ ID NO: 6028 - protein, 8 aa, Artificial Sequence
  synthetic
GFTFSSYG

SEQ ID NO: 6029 - DNA, 24 bp, Artificial Sequence
  synthetic
atatggtatgatggaagtaataca

SEQ ID NO: 6030 - protein, 8 aa, Artificial Sequence
  synthetic
IWYDGSNT

SEQ ID NO: 6031 - DNA, 45 bp, Artificial Sequence
  synthetic
gcgagagatcggcatagtaacagctggttagactacttagaatat

SEQ ID NO: 6032 - protein, 15 aa, Artificial Sequence
  synthetic
ARDRHSNSWLDYLEY

SEQ ID NO: 6033 - DNA, 324 bp, Artificial Sequence
  synthetic
gacatccagatgacccagtctccatcctccctgtctgcttctgtaggagacagagtcaccatcacttgccgggcaagtcaggacattagaaatgatttaggctggtatcaacagacaccagggaaagcccctaagcgcctgatttatgctgcatccagtttacaaagtggggtcccatcaaggttcagcggcagtggatctgggacagaattcactctcacaatcagcagcctgcagcctgaagattttgcaacttattactgtctacaacataatagtcaccctctcactttcggcggagggaccaaggtggagatcaaacga

SEQ ID NO: 6034 - protein, 108 aa, Artificial Sequence
  synthetic
DIQMTQSPSSLSASVGDRVTITCRASQDIRNDLGWYQQTPGKAPKRLIYAASSLQSGVPSRFSGSGSGTEFTLTISSLQPEDFATYYCLQHNSHPLTFGGGTKVEIKR

SEQ ID NO: 6035 - DNA, 18 bp, Artificial Sequence
  synthetic
caggacattagaaatgat

SEQ ID NO: 6036 - protein, 6 aa, Artificial Sequence
  synthetic
QDIRND

SEQ ID NO: 6037 - DNA, 9 bp, Artificial Sequence
  synthetic
gctgcatcc

SEQ ID NO: 6038 - protein, 3 aa, Artificial Sequence
  synthetic
AAS

SEQ ID NO: 6039 - DNA, 27 bp, Artificial Sequence
  synthetic
ctacaacataatagtcaccctctcact

SEQ ID NO: 6040 - protein, 9 aa, Artificial Sequence
  synthetic
LQHNSHPLT

SEQ ID NO: 6041 - DNA, 360 bp, Artificial Sequence
  synthetic
gaggtgcagctggtggagtctggaggaggcttggtccagcctggggggtccctgagactctcctgtgtagcctctgggttcaccgtcactagtaactatatgacctgggtccgccaggctccagggaaggggctggagtgggtctcagttatttataccggtgatacgacacactacgcagactccgtgaagggccgattcaccatctccagacacaattccaagaatacgctgtatcttcaaatgaataccctgagagctgaggacacggccgtgtattactgtgcgagagatagaattacgatccgagactgtggtatggacgtctggggccaagggaccacggtcaccgtctcctca

SEQ ID NO: 6042 - protein, 120 aa, Artificial Sequence
  synthetic
EVQLVESGGGLVQPGGSLRLSCVASGFTVTSNYMTWVRQAPGKGLEWVSVIYTGDTTHYADSVKGRFTISRHNSKNTLYLQMNTLRAEDTAVYYCARDRITIRDCGMDVWGQGTTVTVSS

SEQ ID NO: 6043 - DNA, 24 bp, Artificial Sequence
  synthetic
gggttcaccgtcactagtaactat

SEQ ID NO: 6044 - protein, 8 aa, Artificial Sequence
  synthetic
GFTVTSNY

SEQ ID NO: 6045 - DNA, 21 bp, Artificial Sequence
  synthetic
atttataccggtgatacgaca

SEQ ID NO: 6046 - protein, 7 aa, Artificial Sequence
  synthetic
IYTGDTT

SEQ ID NO: 6047 - DNA, 42 bp, Artificial Sequence
  synthetic
gcgagagatagaattacgatccgagactgtggtatggacgtc

SEQ ID NO: 6048 - protein, 14 aa, Artificial Sequence
  synthetic
ARDRITIRDCGMDV

SEQ ID NO: 6049 - DNA, 324 bp, Artificial Sequence
  synthetic
gacatcctgatgacccagtctccatcttccgtgtctgcatctgtaggagacagagtcaccatcagttgtcgggcgagtcaggatataagcagctggttagcctggtatcagcagaaaccagggaaagcccctaaactcctgatctatgttgcatccagtttgcaaagtggggtcccatcaaggttcagcggcagtggatatgggacagatttcactctcaccatcagcagcctgcagcctgaagattttgcaacttactattgtcaacaggctaacagtttcccgtggacgttcggccaagggaccaaggtggagatcaaacga

SEQ ID NO: 6050 - protein, 108 aa, Artificial Sequence
  synthetic
DILMTQSPSSVSASVGDRVTISCRASQDISSWLAWYQQKPGKAPKLLIYVASSLQSGVPSRFSGSGYGTDFTLTISSLQPEDFATYYCQQANSFPWTFGQGTKVEIKR

SEQ ID NO: 6051 - DNA, 18 bp, Artificial Sequence
  synthetic
caggatataagcagctgg

SEQ ID NO: 6052 - protein, 6 aa, Artificial Sequence
  synthetic
QDISSW

SEQ ID NO: 6053 - DNA, 9 bp, Artificial Sequence
  synthetic
gttgcatcc

SEQ ID NO: 6054 - protein, 3 aa, Artificial Sequence
  synthetic
VAS

SEQ ID NO: 6055 - DNA, 27 bp, Artificial Sequence
  synthetic
caacaggctaacagtttcccgtggacg

SEQ ID NO: 6056 - protein, 9 aa, Artificial Sequence
  synthetic
QQANSFPWT

SEQ ID NO: 6057 - DNA, 366 bp, Artificial Sequence
  synthetic
gaggtgcagctggtggagtctggagcagaggagaaaaagcccggggaatctctgaagatctcctgtaagggttctggatacagctttaccaccttctggatcggctgggtgcgccagatgcccgggcaaggcctggagtggatgggcttcgtctatcctggtgactctgataccagatacagcccgtccttccaaggccaggtcaccatctcagccgacaagtccatcaacaccgcctacctgcagtggagcagcctgaaggcctcggacaccgccatatattactgtgcgagacagctgcgatatatcagttcgtcgggtgcttttgatatctggggccaagggacaatggtcaccgtctcttca

SEQ ID NO: 6058 - protein, 122 aa, Artificial Sequence
  synthetic
EVQLVESGAEEKKPGESLKISCKGSGYSFTTFWIGWVRQMPGQGLEWMGFVYPGDSDTRYSPSFQGQVTISADKSINTAYLQWSSLKASDTAIYYCARQLRYISSSGAFDIWGQGTMVTVSS

SEQ ID NO: 6059 - DNA, 24 bp, Artificial Sequence
  synthetic
ggatacagctttaccaccttctgg

SEQ ID NO: 6060 - protein, 8 aa, Artificial Sequence
  synthetic
GYSFTTFW

SEQ ID NO: 6061 - DNA, 24 bp, Artificial Sequence
  synthetic
gtctatcctggtgactctgatacc

SEQ ID NO: 6062 - protein, 8 aa, Artificial Sequence
  synthetic
VYPGDSDT

SEQ ID NO: 6063 - DNA, 45 bp, Artificial Sequence
  synthetic
gcgagacagctgcgatatatcagttcgtcgggtgcttttgatatc

SEQ ID NO: 6064 - protein, 15 aa, Artificial Sequence
  synthetic
ARQLRYISSSGAFDI

SEQ ID NO: 6065 - DNA, 324 bp, Artificial Sequence
  synthetic
gacatcctgatgacccagtctccatcctccctgtctgcatctgtcggagacagagtcaccatcacttgccgggcaagtcagaccattagtacttatttaaattggtatcagcagaaaccagggaaagcccctaagctcctgatctatggtgtttccagtttgcaaactggggtcccatcaaggttcagtggcagtggatctgtgacagatttcactctcaccgtcagcagtctgcaacctgaagattttgcatcttactactgtcaacagacttacagtcttccgctcactttcggcggagggaccaaggtggagatcaaacga

SEQ ID NO: 6066 - protein, 108 aa, Artificial Sequence
  synthetic
DILMTQSPSSLSASVGDRVTITCRASQTISTYLNWYQQKPGKAPKLLIYGVSSLQTGVPSRFSGSGSVTDFTLTVSSLQPEDFASYYCQQTYSLPLTFGGGTKVEIKR

SEQ ID NO: 6067 - DNA, 18 bp, Artificial Sequence
  synthetic
cagaccattagtacttat

SEQ ID NO: 6068 - protein, 6 aa, Artificial Sequence
  synthetic
QTISTY

SEQ ID NO: 6069 - DNA, 9 bp, Artificial Sequence
  synthetic
ggtgtttcc

SEQ ID NO: 6070 - protein, 3 aa, Artificial Sequence
  synthetic
GVS

SEQ ID NO: 6071 - DNA, 27 bp, Artificial Sequence
  synthetic
caacagacttacagtcttccgctcact

SEQ ID NO: 6072 - protein, 9 aa, Artificial Sequence
  synthetic
QQTYSLPLT

SEQ ID NO: 6073 - DNA, 366 bp, Artificial Sequence
  synthetic
gaggtgcagctggtggagtctggagcagaggtgaaaaagcccggggagtctctgaagatctcctgtaagggttctggatacacctttaccaactactggctcggctgggtgcgccagatgcccgggaaaggcctggaatggatgggattcatccatccttctgactctgataccagatacagtccgtccttccaaggcctggtcaccatgtcagccgacaagtccatcaccaccgcctacctgcagtggagcagcctgaaggcctcggacaccgccatgtattactgtgcgagacagctgcgttatattacctcgtcgggcgcttttgatatctggggccaagggacaatggtcaccgtctcttca

SEQ ID NO: 6074 - protein, 122 aa, Artificial Sequence
  synthetic
EVQLVESGAEVKKPGESLKISCKGSGYTFTNYWLGWVRQMPGKGLEWMGFIHPSDSDTRYSPSFQGLVTMSADKSITTAYLQWSSLKASDTAMYYCARQLRYITSSGAFDIWGQGTMVTVSS

SEQ ID NO: 6075 - DNA, 24 bp, Artificial Sequence
  synthetic
ggatacacctttaccaactactgg

SEQ ID NO: 6076 - protein, 8 aa, Artificial Sequence
  synthetic
GYTFTNYW

SEQ ID NO: 6077 - DNA, 24 bp, Artificial Sequence
  synthetic
atccatccttctgactctgatacc

SEQ ID NO: 6078 - protein, 8 aa, Artificial Sequence
  synthetic
IHPSDSDT

SEQ ID NO: 6079 - DNA, 45 bp, Artificial Sequence
  synthetic
gcgagacagctgcgttatattacctcgtcgggcgcttttgatatc

SEQ ID NO: 6080 - protein, 15 aa, Artificial Sequence
  synthetic
ARQLRYITSSGAFDI

SEQ ID NO: 6081 - DNA, 324 bp, Artificial Sequence
  synthetic
gacatcctgatgacccagtctccatcctccctgtctgcatctgttggagacagagtcaccatcacttgccgggcaagtcagataattagcagctatttaaattggtatcagcaaaacccagggaaggcccctaaactcctgatctatgctatatccactttggaaagtggggtcccatcaaggttcagtggcagtggatctgggacagatttcactttcaccatcagcactctgcaacctgaagattttgcaacttactactgtcagcagacttacagtctcccgctcactttcggcggagggaccaaggtggagatcaaacga

SEQ ID NO: 6082 - protein, 108 aa, Artificial Sequence
  synthetic
DILMTQSPSSLSASVGDRVTITCRASQIISSYLNWYQQNPGKAPKLLIYAISTLESGVPSRFSGSGSGTDFTFTISTLQPEDFATYYCQQTYSLPLTFGGGTKVEIKR

SEQ ID NO: 6083 - DNA, 18 bp, Artificial Sequence
  synthetic
cagataattagcagctat

SEQ ID NO: 6084 - protein, 6 aa, Artificial Sequence
  synthetic
QIISSY

SEQ ID NO: 6085 - DNA, 9 bp, Artificial Sequence
  synthetic
gctatatcc

SEQ ID NO: 6086 - protein, 3 aa, Artificial Sequence
  synthetic
AIS

SEQ ID NO: 6087 - DNA, 27 bp, Artificial Sequence
  synthetic
cagcagacttacagtctcccgctcact

SEQ ID NO: 6088 - protein, 9 aa, Artificial Sequence
  synthetic
QQTYSLPLT

SEQ ID NO: 6089 - DNA, 360 bp, Artificial Sequence
  synthetic
gaggtgcagctggtggagtctggaggaggcttggtccagcctggggggtccctgagactctcctgtgcagcctctgggttcaccgtcagtaacaattatatgacctgggtccgccaggctccagggaaggggctggaatgggtctcagttatttataccggtgagaccacacactacgcagactccgtgatgggccgattcaccatctccagagacatttccaagaacacgctgtatcttcaaatgaacagcctgagaactgaggacacggccgtgtattattgtgcgagagatagaatcacgatccgagactgcggtatggacgtctggggccaagggaccacggtcaccgtctcctca

SEQ ID NO: 6090 - protein, 120 aa, Artificial Sequence
  synthetic
EVQLVESGGGLVQPGGSLRLSCAASGFTVSNNYMTWVRQAPGKGLEWVSVIYTGETTHYADSVMGRFTISRDISKNTLYLQMNSLRTEDTAVYYCARDRITIRDCGMDVWGQGTTVTVSS

SEQ ID NO: 6091 - DNA, 24 bp, Artificial Sequence
  synthetic
gggttcaccgtcagtaacaattat

SEQ ID NO: 6092 - protein, 8 aa, Artificial Sequence
  synthetic
GFTVSNNY

SEQ ID NO: 6093 - DNA, 21 bp, Artificial Sequence
  synthetic
atttataccggtgagaccaca

SEQ ID NO: 6094 - protein, 7 aa, Artificial Sequence
  synthetic
IYTGETT

SEQ ID NO: 6095 - DNA, 42 bp, Artificial Sequence
  synthetic
gcgagagatagaatcacgatccgagactgcggtatggacgtc

SEQ ID NO: 6096 - protein, 14 aa, Artificial Sequence
  synthetic
ARDRITIRDCGMDV

SEQ ID NO: 6097 - DNA, 324 bp, Artificial Sequence
  synthetic
gacatcctgatgacccagtctccatcttccgtgtctgcatctgtaggagacagaatcaccatcacttgtcgggcgagtcaggatattagcagctggttagcctggtatcagcagaaaccaggaaaagcccctaaactcctgatctatattgcttccagtttgcaaagtggggtcccagcaagattcagcggcagtggatctgagacagatttcactctcaccatcagcagcctgcagcctgaagattttgcaacttactattgtcaacaggctaacagtttcccgtggacgttcggccaagggaccaaggtggagatcaaacga

SEQ ID NO: 6098 - protein, 108 aa, Artificial Sequence
  synthetic
DILMTQSPSSVSASVGDRITITCRASQDISSWLAWYQQKPGKAPKLLIYIASSLQSGVPARFSGSGSETDFTLTISSLQPEDFATYYCQQANSFPWTFGQGTKVEIKR

SEQ ID NO: 6099 - DNA, 18 bp, Artificial Sequence
  synthetic
caggatattagcagctgg

SEQ ID NO: 6100 - protein, 6 aa, Artificial Sequence
  synthetic
QDISSW

SEQ ID NO: 6101 - DNA, 9 bp, Artificial Sequence
  synthetic
attgcttcc

SEQ ID NO: 6102 - protein, 3 aa, Artificial Sequence
  synthetic
IAS

SEQ ID NO: 6103 - DNA, 27 bp, Artificial Sequence
  synthetic
caacaggctaacagtttcccgtggacg

SEQ ID NO: 6104 - protein, 9 aa, Artificial Sequence
  synthetic
QQANSFPWT

SEQ ID NO: 6105 - DNA, 363 bp, Artificial Sequence
  synthetic
gaggtgcagctggtggagtctggagcagaaatgagaaagcccggggagtctctgaggatttcctgtaaggattctggatacaggttaaccaacaactggatcggctgggtgcgccaaatgcccgggaaaggcctggagtggatggggatcatctatcctggtgactctgatgccagatacagtccgtccttccaaggccaggtcaccatctcagccgacaagtccatcaacaccgcctacctgcagtggagcagcctgaaggcctcggacaccgccatgtattactgtgcgagacaagccggtataagtagaagtatgtgctttgactcctggggccagggaaccatggtcaccgtctcctca

SEQ ID NO: 6106 - protein, 121 aa, Artificial Sequence
  synthetic
EVQLVESGAEMRKPGESLRISCKDSGYRLTNNWIGWVRQMPGKGLEWMGIIYPGDSDARYSPSFQGQVTISADKSINTAYLQWSSLKASDTAMYYCARQAGISRSMCFDSWGQGTMVTVSS

SEQ ID NO: 6107 - DNA, 24 bp, Artificial Sequence
  synthetic
ggatacaggttaaccaacaactgg

SEQ ID NO: 6108 - protein, 8 aa, Artificial Sequence
  synthetic
GYRLTNNW

SEQ ID NO: 6109 - DNA, 24 bp, Artificial Sequence
  synthetic
atctatcctggtgactctgatgcc

SEQ ID NO: 6110 - protein, 8 aa, Artificial Sequence
  synthetic
IYPGDSDA

SEQ ID NO: 6111 - DNA, 42 bp, Artificial Sequence
  synthetic
gcgagacaagccggtataagtagaagtatgtgctttgactcc

SEQ ID NO: 6112 - protein, 14 aa, Artificial Sequence
  synthetic
ARQAGISRSMCFDS

SEQ ID NO: 6113 - DNA, 324 bp, Artificial Sequence
  synthetic
gacatcgtgatgacccagtctccatcttccctgtctgcatctgtaggagacagagtcaccgtcacttgccgggcaagtcagagaattaacagttatttaaattggtatcagcaaagaccagggatagtccctaagatcctgatctattttgcatccagtttgcagagtggggtcccatcaaggttcagtggcagtggatctgggacagatttcactctcaccatcagcagtctgcaacctgaagattttgcaatttattattgtcaacagagttacattctcccgtacacttttggccaggggaccaaggtggagatcaaacga

SEQ ID NO: 6114 - protein, 108 aa, Artificial Sequence
  synthetic
DIVMTQSPSSLSASVGDRVTVTCRASQRINSYLNWYQQRPGIVPKILIYFASSLQSGVPSRFSGSGSGTDFTLTISSLQPEDFAIYYCQQSYILPYTFGQGTKVEIKR

SEQ ID NO: 6115 - DNA, 18 bp, Artificial Sequence
  synthetic
cagagaattaacagttat

SEQ ID NO: 6116 - protein, 6 aa, Artificial Sequence
  synthetic
QRINSY

SEQ ID NO: 6117 - DNA, 9 bp, Artificial Sequence
  synthetic
tttgcatcc

SEQ ID NO: 6118 - protein, 3 aa, Artificial Sequence
  synthetic
FAS

SEQ ID NO: 6119 - DNA, 27 bp, Artificial Sequence
  synthetic
caacagagttacattctcccgtacact

SEQ ID NO: 6120 - protein, 9 aa, Artificial Sequence
  synthetic
QQSYILPYT

SEQ ID NO: 6121 - DNA, 360 bp, Artificial Sequence
  synthetic
caggtgcagctggtggagtctggaggaggcttggtccaacctggggggtccctgagactctcctgtgcagcctctgggttctccgtcaatagcaattacatgacctgggtccgccaggctccagggaaggggctggagtgggtctcagttatctataccggtgataccacacactacgcagactccgtgaagggccgattcaccatctccagagacacttccaagaacaccctgtttcttcaaatgaacagcctgagatctgaggacacggccgtttattactgtgcgagagacagaatcacgatccgagattgcggtatggacgtctggggccaagggaccacggtcaccgtctcctca

SEQ ID NO: 6122 - protein, 120 aa, Artificial Sequence
  synthetic
QVQLVESGGGLVQPGGSLRLSCAASGFSVNSNYMTWVRQAPGKGLEWVSVIYTGDTTHYADSVKGRFTISRDTSKNTLFLQMNSLRSEDTAVYYCARDRITIRDCGMDVWGQGTTVTVSS

SEQ ID NO: 6123 - DNA, 24 bp, Artificial Sequence
  synthetic
gggttctccgtcaatagcaattac

SEQ ID NO: 6124 - protein, 8 aa, Artificial Sequence
  synthetic
GFSVNSNY

SEQ ID NO: 6125 - DNA, 21 bp, Artificial Sequence
  synthetic
atctataccggtgataccaca

SEQ ID NO: 6126 - protein, 7 aa, Artificial Sequence
  synthetic
IYTGDTT

SEQ ID NO: 6127 - DNA, 42 bp, Artificial Sequence
  synthetic
gcgagagacagaatcacgatccgagattgcggtatggacgtc

SEQ ID NO: 6128 - protein, 14 aa, Artificial Sequence
  synthetic
ARDRITIRDCGMDV

SEQ ID NO: 6129 - DNA, 324 bp, Artificial Sequence
  synthetic
gacatccagatgacccagtctccatcttccgtgtctgcatctgtaggagacagagtcaccatcacttgtcgggcgagtcaggatattagcagctggttagcctggtatcagcagaaaccagggaaagcccctaagctcctgatctatgttgcatccagtttgcaaagtggggtcccatcaaggttcagcggcggtggatctgggacagatttcactctcaccatcagcagcctgcagcctgaagattttgcaacttactactgtcaacaggctaacagtttcccgtggacgttcggccaagggaccaaggtggagatcaaacga

SEQ ID NO: 6130 - protein, 108 aa, Artificial Sequence
  synthetic
DIQMTQSPSSVSASVGDRVTITCRASQDISSWLAWYQQKPGKAPKLLIYVASSLQSGVPSRFSGGGSGTDFTLTISSLQPEDFATYYCQQANSFPWTFGQGTKVEIKR

SEQ ID NO: 6131 - DNA, 18 bp, Artificial Sequence
  synthetic
caggatattagcagctgg

SEQ ID NO: 6132 - protein, 6 aa, Artificial Sequence
  synthetic
QDISSW

SEQ ID NO: 6133 - DNA, 9 bp, Artificial Sequence
  synthetic
gttgcatcc

SEQ ID NO: 6134 - protein, 3 aa, Artificial Sequence
  synthetic
VAS

SEQ ID NO: 6135 - DNA, 27 bp, Artificial Sequence
  synthetic
caacaggctaacagtttcccgtggacg

SEQ ID NO: 6136 - protein, 9 aa, Artificial Sequence
  synthetic
QQANSFPWT

SEQ ID NO: 6137 - DNA, 363 bp, Artificial Sequence
  synthetic
caggtgcagctggtggagtctggagcagaggtgaaaaagcccggggaatctctgaagatttcctgtaaggattctggatacaggtttaccaagtcctggatcggctgggtgcgccagatgcccgggaaaggcctggagtggatggggatcatctatcctggtgactctgatatcagatacagcccgtccttccaaggccaggtcatcatctcagccgacaagtccatcaacaccgcctacctgcagtgggacagcctgaaggcctcggacaccgccatgtattactgtgcgaaacaagccggtataacaagaagtatgtgctttgactcctggggccagggaaccctggtcaccgtctcctca

SEQ ID NO: 6138 - protein, 121 aa, Artificial Sequence
  synthetic
QVQLVESGAEVKKPGESLKISCKDSGYRFTKSWIGWVRQMPGKGLEWMGIIYPGDSDIRYSPSFQGQVIISADKSINTAYLQWDSLKASDTAMYYCAKQAGITRSMCFDSWGQGTLVTVSS

SEQ ID NO: 6139 - DNA, 24 bp, Artificial Sequence
  synthetic
ggatacaggtttaccaagtcctgg

SEQ ID NO: 6140 - protein, 8 aa, Artificial Sequence
  synthetic
GYRFTKSW

SEQ ID NO: 6141 - DNA, 24 bp, Artificial Sequence
  synthetic
atctatcctggtgactctgatatc

SEQ ID NO: 6142 - protein, 8 aa, Artificial Sequence
  synthetic
IYPGDSDI

SEQ ID NO: 6143 - DNA, 42 bp, Artificial Sequence
  synthetic
gcgaaacaagccggtataacaagaagtatgtgctttgactcc

SEQ ID NO: 6144 - protein, 14 aa, Artificial Sequence
  synthetic
AKQAGITRSMCFDS

SEQ ID NO: 6145 - DNA, 324 bp, Artificial Sequence
  synthetic
gacatcgtgatgacccagtctccatcttccctgtctgcatctgtaggagacagagtcaccatcacttgccgggcaaatcagagaattagcagctatttaaattggtatcagcagagaccagggaaagcccctaatctcctgatctattttgcctccagtttgcagagtggggtcccatcaaggttcagtggcagtggatctgggacagatttcactctcactatcaatagtctgcaacctgaagattttgcaacttactattgtcaacagagttacagtattccgtacacttttggccaggggaccaaggtggagatcaaacga

SEQ ID NO: 6146 - protein, 108 aa, Artificial Sequence
  synthetic
DIVMTQSPSSLSASVGDRVTITCRANQRISSYLNWYQQRPGKAPNLLIYFASSLQSGVPSRFSGSGSGTDFTLTINSLQPEDFATYYCQQSYSIPYTFGQGTKVEIKR

SEQ ID NO: 6147 - DNA, 18 bp, Artificial Sequence
  synthetic
cagagaattagcagctat

SEQ ID NO: 6148 - protein, 6 aa, Artificial Sequence
  synthetic
QRISSY

SEQ ID NO: 6149 - DNA, 9 bp, Artificial Sequence
  synthetic
tttgcctcc

SEQ ID NO: 6150 - protein, 3 aa, Artificial Sequence
  synthetic
FAS

SEQ ID NO: 6151 - DNA, 27 bp, Artificial Sequence
  synthetic
caacagagttacagtattccgtacact

SEQ ID NO: 6152 - protein, 9 aa, Artificial Sequence
  synthetic
QQSYSIPYT

SEQ ID NO: 6153 - DNA, 372 bp, Artificial Sequence
  synthetic
caggtgcagctggtggagtcggggggaggcttggtacagcctggcaggtccctgagactctcctgtgcagcctctggattcacctttcatgattatgccatacactgggtccggcaagctccagggaagggcctggactgggtctcaggtattagttggaatagtgatacgatagcctatgcggactctgtgaagggccgattcaccatctccagagacaacgccaagaactccctgtatctgcaaatgaacagtctgagagctgaggacacggccttgtattactgtgcaaaagatactaacgatattttgactggttattataacccttttgactactggggccagggaaccatggtcaccgtctcctca

SEQ ID NO: 6154 - protein, 124 aa, Artificial Sequence
  synthetic
QVQLVESGGGLVQPGRSLRLSCAASGFTFHDYAIHWVRQAPGKGLDWVSGISWNSDTIAYADSVKGRFTISRDNAKNSLYLQMNSLRAEDTALYYCAKDTNDILTGYYNPFDYWGQGTMVTVSS

SEQ ID NO: 6155 - DNA, 24 bp, Artificial Sequence
  synthetic
ggattcacctttcatgattatgcc

SEQ ID NO: 6156 - protein, 8 aa, Artificial Sequence
  synthetic
GFTFHDYA

SEQ ID NO: 6157 - DNA, 24 bp, Artificial Sequence
  synthetic
attagttggaatagtgatacgata

SEQ ID NO: 6158 - protein, 8 aa, Artificial Sequence
  synthetic
ISWNSDTI

SEQ ID NO: 6159 - DNA, 51 bp, Artificial Sequence
  synthetic
gcaaaagatactaacgatattttgactggttattataacccttttgactac

SEQ ID NO: 6160 - protein, 17 aa, Artificial Sequence
  synthetic
AKDTNDILTGYYNPFDY

SEQ ID NO: 6161 - DNA, 324 bp, Artificial Sequence
  synthetic
gacatccagatgacccagtctccatcctccctgtctgcatctgtgggagacagagtcaccatcacttgccgggcgagtcagggcattagcaattatttagcctggtatcagcagaaaccagggaaagttcctaagctcctgatctctgctgcatcgactttgcaatcgggggtcccatctcggttcagtggcagtggatctgggacagatttcactctcaccatcagcagcctgcagcctgaagatgttgcaatttattactgtcaaaagtataacggtgacccattcactttcggccctgggaccaaggtggagatcaaacga

SEQ ID NO: 6162 - protein, 108 aa, Artificial Sequence
  synthetic
DIQMTQSPSSLSASVGDRVTITCRASQGISNYLAWYQQKPGKVPKLLISAASTLQSGVPSRFSGSGSGTDFTLTISSLQPEDVAIYYCQKYNGDPFTFGPGTKVEIKR

SEQ ID NO: 6163 - DNA, 18 bp, Artificial Sequence
  synthetic
cagggcattagcaattat

SEQ ID NO: 6164 - protein, 6 aa, Artificial Sequence
  synthetic
QGISNY

SEQ ID NO: 6165 - DNA, 9 bp, Artificial Sequence
  synthetic
gctgcatcg

SEQ ID NO: 6166 - protein, 3 aa, Artificial Sequence
  synthetic
AAS

SEQ ID NO: 6167 - DNA, 27 bp, Artificial Sequence
  synthetic
caaaagtataacggtgacccattcact

SEQ ID NO: 6168 - protein, 9 aa, Artificial Sequence
  synthetic
QKYNGDPFT

SEQ ID NO: 6169 - DNA, 360 bp, Artificial Sequence
  synthetic
gaggtgcagctggtggagtctggaggaggcttggtccagcctggggggtccctgagactctcctgtgcagcctctgggttcaccgtcagtaacaattatatgacctgggtccgtcaggctccagggaaggggctggaatgggtctcagttatttataccggtgagaccacacactacgcagactccgtgatgggccgattcaccatctccagagacatttacaagaacacgctgtatcttcaaatgaacagcctgagaactgaggacacggccgtgtattactgtgcgagagatagaatcacgatccgagactgcggtatggacgtctggggccaagggaccacggtcaccgtctcctca

SEQ ID NO: 6170 - protein, 120 aa, Artificial Sequence
  synthetic
EVQLVESGGGLVQPGGSLRLSCAASGFTVSNNYMTWVRQAPGKGLEWVSVIYTGETTHYADSVMGRFTISRDIYKNTLYLQMNSLRTEDTAVYYCARDRITIRDCGMDVWGQGTTVTVSS

SEQ ID NO: 6171 - DNA, 24 bp, Artificial Sequence
  synthetic
gggttcaccgtcagtaacaattat

SEQ ID NO: 6172 - protein, 8 aa, Artificial Sequence
  synthetic
GFTVSNNY

SEQ ID NO: 6173 - DNA, 21 bp, Artificial Sequence
  synthetic
atttataccggtgagaccaca

SEQ ID NO: 6174 - protein, 7 aa, Artificial Sequence
  synthetic
IYTGETT

SEQ ID NO: 6175 - DNA, 42 bp, Artificial Sequence; identical to SEQ ID NO: 6095
  synthetic

SEQ ID NO: 6176 - protein, 14 aa, Artificial Sequence
  synthetic
ARDRITIRDCGMDV

SEQ ID NO: 6177 - DNA, 324 bp, Artificial Sequence
  synthetic
gacatcctgatgacccagtctccatcttccgtgtctgcatctgtaggagacagaatcaccatcacttgtcgggcgagtcaggatattagcagctggttagcctggtatcagcagaaaccaggaaaagcccctaaactcctgatctatgttgcttccagtttgcaaagtggggtcccagcaagattcagcggcagtggatctgagacagatttcactctcaccatcagcagcctgcagcctgaagattttgcaacttattactgtctacaagattacaattacccgtggacgttcggccaagggaccaaggtggagatcaaacga

SEQ ID NO: 6178 - protein, 108 aa, Artificial Sequence
  synthetic
DILMTQSPSSVSASVGDRITITCRASQDISSWLAWYQQKPGKAPKLLIYVASSLQSGVPARFSGSGSETDFTLTISSLQPEDFATYYCLQDYNYPWTFGQGTKVEIKR

SEQ ID NO: 6179 - DNA, 18 bp, Artificial Sequence
  synthetic
caggatattagcagctgg

SEQ ID NO: 6180 - protein, 6 aa, Artificial Sequence
  synthetic
QDISSW

SEQ ID NO: 6181 - DNA, 9 bp, Artificial Sequence
  synthetic
gttgcttcc

SEQ ID NO: 6182 - protein, 3 aa, Artificial Sequence
  synthetic
VAS

SEQ ID NO: 6183 - DNA, 27 bp, Artificial Sequence
  synthetic
ctacaagattacaattacccgtggacg

SEQ ID NO: 6184 - protein, 9 aa, Artificial Sequence
  synthetic
LQDYNYPWT

SEQ ID NO: 6185 - DNA, 360 bp, Artificial Sequence; identical to SEQ ID NO: 6089
  synthetic

SEQ ID NO: 6186 - protein, 120 aa, Artificial Sequence; identical to SEQ ID NO: 6090
  synthetic

SEQ ID NO: 6187 - DNA, 24 bp, Artificial Sequence
  synthetic
gggttcaccgtcagtaacaattat

SEQ ID NO: 6188 - protein, 8 aa, Artificial Sequence
  synthetic
GFTVSNNY

SEQ ID NO: 6189 - DNA, 21 bp, Artificial Sequence
  synthetic
atttataccggtgagaccaca

SEQ ID NO: 6190 - protein, 7 aa, Artificial Sequence
  synthetic
IYTGETT

SEQ ID NO: 6191 - DNA, 42 bp, Artificial Sequence; identical to SEQ ID NO: 6095
  synthetic

SEQ ID NO: 6192 - protein, 14 aa, Artificial Sequence
  synthetic
ARDRITIRDCGMDV

SEQ ID NO: 6193 - DNA, 324 bp, Artificial Sequence
  synthetic
gacatccagatgacccagtctccatcttccgtgtctgcatctgtaggagacagaatcaccatcacttgtcgggcgagtcaggatattagcagctggttagcctggtatcagcagaaaccaggaaaagcccctaaactcctgatctatattgcttccagtttgcaaagtggggtcccagcaagattcagcggcagtggatctgagacagatttcactctcaccatcagcagcctgcagcctgaagattttgcaacttactattgtcaacaggctaacagtttcccgtggacgttcggccaagggaccaaggtggagatcaaacga

SEQ ID NO: 6194 - protein, 108 aa, Artificial Sequence
  synthetic
DIQMTQSPSSVSASVGDRITITCRASQDISSWLAWYQQKPGKAPKLLIYIASSLQSGVPARFSGSGSETDFTLTISSLQPEDFATYYCQQANSFPWTFGQGTKVEIKR

SEQ ID NO: 6195 - DNA, 18 bp, Artificial Sequence
  synthetic
caggatattagcagctgg

SEQ ID NO: 6196 - protein, 6 aa, Artificial Sequence
  synthetic
QDISSW

SEQ ID NO: 6197 - DNA, 9 bp, Artificial Sequence
  synthetic
attgcttcc

SEQ ID NO: 6198 - protein, 3 aa, Artificial Sequence
  synthetic
IAS

SEQ ID NO: 6199 - DNA, 27 bp, Artificial Sequence
  synthetic
caacaggctaacagtttcccgtggacg

SEQ ID NO: 6200 - protein, 9 aa, Artificial Sequence
  synthetic
QQANSFPWT

SEQ ID NO: 6201 - DNA, 363 bp, Artificial Sequence
  synthetic
gaggtgcagctggtggagtctgggggaggcttggtccagcctggggggtccctgagactctcctgtgcagcctctggattcaccttcagtagctatgctatgcactgggtccgccaggctccagggaagggactggaatatgtttcaggtataagtggtaatgggtatagtacatattatgcagactctgtgaagggcagattcaccatctccagagacaattccaagaacacgctgtatcttcaaatgggcagcctgagacctgaggacatgtctgtgtattattgtgcgagaggggcaatgactggaaccctcggagggtttgactactggggccagggaaccctggtcaccgtctcctca

SEQ ID NO: 6202 - protein, 121 aa, Artificial Sequence
  synthetic
EVQLVESGGGLVQPGGSLRLSCAASGFTFSSYAMHWVRQAPGKGLEYVSGISGNGYSTYYADSVKGRFTISRDNSKNTLYLQMGSLRPEDMSVYYCARGAMTGTLGGFDYWGQGTLVTVSS

SEQ ID NO: 6203 - DNA, 24 bp, Artificial Sequence
  synthetic
ggattcaccttcagtagctatgct

SEQ ID NO: 6204 - protein, 8 aa, Artificial Sequence
  synthetic
GFTFSSYA

SEQ ID NO: 6205 - DNA, 24 bp, Artificial Sequence
  synthetic
ataagtggtaatgggtatagtaca

SEQ ID NO: 6206 - protein, 8 aa, Artificial Sequence
  synthetic
ISGNGYST

SEQ ID NO: 6207 - DNA, 42 bp, Artificial Sequence
  synthetic
gcgagaggggcaatgactggaaccctcggagggtttgactac

SEQ ID NO: 6208 - protein, 14 aa, Artificial Sequence
  synthetic
ARGAMTGTLGGFDY

SEQ ID NO: 6209 - DNA, 324 bp, Artificial Sequence
  synthetic
gacatccagatgacccagtctccatcctcactgtctgcatctgtgggagacagagtcaccatcacttgtcgggcgagtcaggacattaacaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaatattttgcaacttattactgccaacagtataatagtttcccgtggacgttcggccaagggaccaaggtggagatcaaacga

SEQ ID NO: 6210 - protein, 108 aa, Artificial Sequence
  synthetic
DIQMTQSPSSLSASVGDRVTITCRASQDINNYLAWFQQKPGKAPKSLIYAASSLQSGVPSKFSGSGSGTDFTLTISSLQPEYFATYYCQQYNSFPWTFGQGTKVEIKR

SEQ ID NO: 6211 - DNA, 18 bp, Artificial Sequence
  synthetic
caggacattaacaattat

SEQ ID NO: 6212 - protein, 6 aa, Artificial Sequence
  synthetic
QDINNY

SEQ ID NO: 6213 - DNA, 9 bp, Artificial Sequence
  synthetic
gctgcatcc

SEQ ID NO: 6214 - protein, 3 aa, Artificial Sequence
  synthetic
AAS

SEQ ID NO: 6215 - DNA, 27 bp, Artificial Sequence
  synthetic
caacagtataatagtttcccgtggacg

SEQ ID NO: 6216 - protein, 9 aa, Artificial Sequence
  synthetic
QQYNSFPWT

SEQ ID NO: 6217 - DNA, 366 bp, Artificial Sequence
  synthetic
gaggtgcagctggtggagtctgggggaggcgtggtccagcctgggaggtccctgagactctcctgtacagcgtctggattcaccttcagtagctatggcatgcactgggtccgccaggctccaggcaaggggctggagtggatggcagatatatggtatgatggaagtaatacagactatgtagactccgtgaagggccgattcaccatctcaagagacaattccaagaacacgttgtatctccaaatgaacagcctgagagtcgaggacacggctgtgtattactgtgcgagagatcggcatagtaacagctggttagactacttagaatattggggccagggaaccctggtcaccgtctcctca

SEQ ID NO: 6218 - protein, 122 aa, Artificial Sequence
  synthetic
EVQLVESGGGVVQPGRSLRLSCTASGFTFSSYGMHWVRQAPGKGLEWMADIWYDGSNTDYVDSVKGRFTISRDNSKNTLYLQMNSLRVEDTAVYYCARDRHSNSWLDYLEYWGQGTLVTVSS

SEQ ID NO: 6219 - DNA, 24 bp, Artificial Sequence
  synthetic
ggattcaccttcagtagctatggc

SEQ ID NO: 6220 - protein, 8 aa, Artificial Sequence
  synthetic
GFTFSSYG

SEQ ID NO: 6221 - DNA, 24 bp, Artificial Sequence
  synthetic
atatggtatgatggaagtaataca

SEQ ID NO: 6222 - protein, 8 aa, Artificial Sequence
  synthetic
IWYDGSNT

SEQ ID NO: 6223 - DNA, 45 bp, Artificial Sequence; identical to SEQ ID NO: 6031
  synthetic

SEQ ID NO: 6224 - protein, 15 aa, Artificial Sequence
  synthetic
ARDRHSNSWLDYLEY

SEQ ID NO: 6225 - DNA, 324 bp, Artificial Sequence
  synthetic
gacatcctgatgacccagtctccatcctccctgtctgcttctgtaggagacagagtcaccatcacttgccgggcaagtcaggacattagaaatgatttaggctggtatcagcagacaccagggaaagcccctaagcgcctgatttatgctgcatccagtttacaaagtggggtcccatcaaggttcagcggcagtggatctgggacagaattcactctcacagtcagcagcctgcagcctgaagattttgcaacttattactgtctacaacataatagtcaccctctcactttcggcggagggaccaaggtggagatcaaacga

SEQ ID NO: 6226 - protein, 108 aa, Artificial Sequence
  synthetic
DILMTQSPSSLSASVGDRVTITCRASQDIRNDLGWYQQTPGKAPKRLIYAASSLQSGVPSRFSGSGSGTEFTLTVSSLQPEDFATYYCLQHNSHPLTFGGGTKVEIKR

SEQ ID NO: 6227 - DNA, 18 bp, Artificial Sequence
  synthetic
caggacattagaaatgat

SEQ ID NO: 6228 - protein, 6 aa, Artificial Sequence
  synthetic
QDIRND

SEQ ID NO: 6229 - DNA, 9 bp, Artificial Sequence
  synthetic
gctgcatcc

SEQ ID NO: 6230 - protein, 3 aa, Artificial Sequence
  synthetic
AAS

SEQ ID NO: 6231 - DNA, 27 bp, Artificial Sequence
  synthetic
ctacaacataatagtcaccctctcact

SEQ ID NO: 6232 - protein, 9 aa, Artificial Sequence
  synthetic
LQHNSHPLT

SEQ ID NO: 6233 - DNA, 369 bp, Artificial Sequence
  synthetic
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagggatttttggagtggttattacccgaatacttccagcactggggccagggcaccatggtcaccgtctcctca

SEQ ID NO: 6234 - protein, 123 aa, Artificial Sequence
  synthetic
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGFLEWLLPEYFQHWGQGTMVTVSS

SEQ ID NO: 6235 - DNA, 24 bp, Artificial Sequence
  synthetic
ggattcacctttagcagctatgcc

SEQ ID NO: 6236 - protein, 8 aa, Artificial Sequence
  synthetic
GFTFSSYA

SEQ ID NO: 6237 - DNA, 24 bp, Artificial Sequence
  synthetic
attagtggtagtggtggtagcaca

SEQ ID NO: 6238 - protein, 8 aa, Artificial Sequence
  synthetic
ISGSGGST

SEQ ID NO: 6239 - DNA, 48 bp, Artificial Sequence
  synthetic
gcgaaagagggatttttggagtggttattacccgaatacttccagcac

SEQ ID NO: 6240 - protein, 16 aa, Artificial Sequence
  synthetic
AKEGFLEWLLPEYFQH

SEQ ID NO: 6241 - DNA, 327 bp, Artificial Sequence
  synthetic
gacatcgtgatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaaggtggagatcaaacga

SEQ ID NO: 6242 - protein, 109 aa, Artificial Sequence
  synthetic
DIVMTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKR

SEQ ID NO: 6243 - DNA, 21 bp, Artificial Sequence
  synthetic
cagagtgttagcagcagctac

SEQ ID NO: 6244 - protein, 7 aa, Artificial Sequence
  synthetic
QSVSSSY

SEQ ID NO: 6245 - DNA, 9 bp, Artificial Sequence
  synthetic
ggtgcatcc

SEQ ID NO: 6246 - protein, 3 aa, Artificial Sequence
  synthetic
GAS

SEQ ID NO: 6247 - DNA, 27 bp, Artificial Sequence
  synthetic
cagcagtatggtagctcacctcggacg

SEQ ID NO: 6248 - protein, 9 aa, Artificial Sequence
  synthetic
QQYGSSPRT

SEQ ID NO: 6249 - DNA, 363 bp, Artificial Sequence
  synthetic
caggtgcagctggtggagtctggaccagaggtgagaaagcccggggagtctctgaggatttcctgtaaggattctggaaacagattaaccaacaactggatcggctgggtgcgccagatgcccgggaaaggcctggagtggatggggatcatctctcctggtgactctgatatcagatacagtccgtccttccaaggccaggtcaccatctcagccgacaagtccatcaacaccgcctacctgcagtggtacagcctgaaggcctcggacaccgccatctattattgtgcgagacaagccggtataacgagaagtatgtgctttgactattggggccagggaaccctggtcaccgtctcctca

SEQ ID NO: 6250 - protein, 121 aa, Artificial Sequence
  synthetic
QVQLVESGPEVRKPGESLRISCKDSGNRLTNNWIGWVRQMPGKGLEWMGIISPGDSDIRYSPSFQGQVTISADKSINTAYLQWYSLKASDTAIYYCARQAGITRSMCFDYWGQGTLVTVSS

SEQ ID NO: 6251 - DNA, 24 bp, Artificial Sequence
  synthetic
ggaaacagattaaccaacaactgg

SEQ ID NO: 6252 - protein, 8 aa, Artificial Sequence
  synthetic
GNRLTNNW

SEQ ID NO: 6253 - DNA, 24 bp, Artificial Sequence
  synthetic
atctctcctggtgactctgatatc

SEQ ID NO: 6254 - protein, 8 aa, Artificial Sequence
  synthetic
ISPGDSDI

SEQ ID NO: 6255 - DNA, 42 bp, Artificial Sequence
  synthetic
gcgagacaagccggtataacgagaagtatgtgctttgactat

SEQ ID NO: 6256 - protein, 14 aa, Artificial Sequence
  synthetic
ARQAGITRSMCFDY

SEQ ID NO: 6257 - DNA, 324 bp, Artificial Sequence
  synthetic
gacatcgtgatgacccagtctccatcttccctgtctgcatctgtaggagacagagtcaccgtcacttgccgggcaagtcagagaattaacagctatttaaattggtatcagcaaagaccagggatagcccctaagctcctgatctattttgcatccagtttacagagtggggtcccatcaaggttcagtggcagtggatctgggacagatttcactctcaccatcagcagtctgctacctgaagattttgcaatttactactgtcaacagacttacattatcccgtacacttttggccaggggaccaaggtggagatcaaacga

SEQ ID NO: 6258 - protein, 108 aa, Artificial Sequence
  synthetic
DIVMTQSPSSLSASVGDRVTVTCRASQRINSYLNWYQQRPGIAPKLLIYFASSLQSGVPSRFSGSGSGTDFTLTISSLLPEDFAIYYCQQTYIIPYTFGQGTKVEIKR

SEQ ID NO: 6259 - DNA, 18 bp, Artificial Sequence
  synthetic
cagagaattaacagctat

SEQ ID NO: 6260 - protein, 6 aa, Artificial Sequence
  synthetic
QRINSY

SEQ ID NO: 6261 - DNA, 9 bp, Artificial Sequence
  synthetic
tttgcatcc

SEQ ID NO: 6262 - protein, 3 aa, Artificial Sequence
  synthetic
FAS

SEQ ID NO: 6263 - DNA, 27 bp, Artificial Sequence
  synthetic
caacagacttacattatcccgtacact

SEQ ID NO: 6264 - protein, 9 aa, Artificial Sequence
  synthetic
QQTYIIPYT

SEQ ID NO: 6265 - DNA, 363 bp, Artificial Sequence
  synthetic
gaggtgcagctggtggagtctggggggggcttggtccagcctggggggtccctgagactctcctgtgcagcctctggattcaccttcagtagctatgctatgcactgggtccgccaggctccagggaagggactggaatatgtttcagctattagtggtagtgggtatagcacatattatgcagactctgtgaagggcagattcaccatctccagagacaattccaagaacacgctgtatcttcaaatgggcagcctgagacctgaggacatggctgtgtattactgtgcgagaggggcaatgactggaaccctcggagggtttgactactggggccagggaaccctggtcaccgtctcctca

SEQ ID NO: 6266 - protein, 121 aa, Artificial Sequence
  synthetic
EVQLVESGGGLVQPGGSLRLSCAASGFTFSSYAMHWVRQAPGKGLEYVSAISGSGYSTYYADSVKGRFTISRDNSKNTLYLQMGSLRPEDMAVYYCARGAMTGTLGGFDYWGQGTLVTVSS

SEQ ID NO: 6267 - DNA, 24 bp, Artificial Sequence
  synthetic
ggattcaccttcagtagctatgct

SEQ ID NO: 6268 - protein, 8 aa, Artificial Sequence
  synthetic
GFTFSSYA

SEQ ID NO: 6269 - DNA, 24 bp, Artificial Sequence
  synthetic
attagtggtagtgggtatagcaca

SEQ ID NO: 6270 - protein, 8 aa, Artificial Sequence
  synthetic
ISGSGYST

SEQ ID NO: 6271 - DNA, 42 bp, Artificial Sequence; identical to SEQ ID NO: 6207
  synthetic

SEQ ID NO: 6272 - protein, 14 aa, Artificial Sequence
  synthetic
ARGAMTGTLGGFDY

SEQ ID NO: 6273 - DNA, 324 bp, Artificial Sequence
  synthetic
gacatcctgatgacccagtctccatcctcactgtctgcatctgtaggagacagagtcaccatcacttgtcgggcgagtcaggacattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaattttttgcaacttattactgccaacagtataatagtttcccgtggacgttcggccaagggaccaaggtggagatcaaacga

SEQ ID NO: 6274 - protein, 108 aa, Artificial Sequence
  synthetic
DILMTQSPSSLSASVGDRVTITCRASQDISNYLAWFQQKPGKAPKSLIYAASSLQSGVPSKFSGSGSGTDFTLTISSLQPEFFATYYCQQYNSFPWTFGQGTKVEIKR

SEQ ID NO: 6275 - DNA, 18 bp, Artificial Sequence
  synthetic
caggacattagcaattat

SEQ ID NO: 6276 - protein, 6 aa, Artificial Sequence
  synthetic
QDISNY

SEQ ID NO: 6277 - DNA, 9 bp, Artificial Sequence
  synthetic
gctgcatcc

SEQ ID NO: 6278 - protein, 3 aa, Artificial Sequence
  synthetic
AAS

SEQ ID NO: 6279 - DNA, 27 bp, Artificial Sequence
  synthetic
caacagtataatagtttcccgtggacg

SEQ ID NO: 6280 - protein, 9 aa, Artificial Sequence
  synthetic
QQYNSFPWT

SEQ ID NO: 6281 - DNA, 366 bp, Artificial Sequence
  synthetic
caggtgcagctggtggagtctggagcagaggtgaaaaagtccggggagtctctgaagatctcctgtaagggttctgaaaacaactttgccaactactggatcgcctgggtgcgccagatgcccgggaaaggcctggagtggatggggctcatctaccctggtgactctgataccagatatagtccgtccttccaaggccaggtcaccatctcagccgacaagtccatcagtaccgcctacttgcagtggaacagcctgaagacctcggacacctccatgtattactgtgcgagacagctgcgctatatcacctcgtcgggttcttttgatatctggggccaaggaacaatggtcaccgtctcttca

SEQ ID NO: 6282 - protein, 122 aa, Artificial Sequence
  synthetic
QVQLVESGAEVKKSGESLKISCKGSENNFANYWIAWVRQMPGKGLEWMGLIYPGDSDTRYSPSFQGQVTISADKSISTAYLQWNSLKTSDTSMYYCARQLRYITSSGSFDIWGQGTMVTVSS

SEQ ID NO: 6283 - DNA, 24 bp, Artificial Sequence
  synthetic
gaaaacaactttgccaactactgg

SEQ ID NO: 6284 - protein, 8 aa, Artificial Sequence
  synthetic
ENNFANYW

SEQ ID NO: 6285 - DNA, 24 bp, Artificial Sequence
  synthetic
atctaccctggtgactctgatacc

SEQ ID NO: 6286 - protein, 8 aa, Artificial Sequence
  synthetic
IYPGDSDT

SEQ ID NO: 6287 - DNA, 45 bp, Artificial Sequence
  synthetic
gcgagacagctgcgctatatcacctcgtcgggttcttttgatatc

SEQ ID NO: 6288 - protein, 15 aa, Artificial Sequence
  synthetic
ARQLRYITSSGSFDI

SEQ ID NO: 6289 - DNA, 324 bp, Artificial Sequence
  synthetic
gacatcgtgatgacccagtctccatcctccctgtctgcatctgttggagacagagtcaccatcacttgccgggcaagtcagaccattagcagctatttaaattggtatcagcagaaaccagggaaagcccctaaactcctgatctatggtgtatccaatttgcaaagtgctgtcccatcaaggttcagtggcagtggatctgggacagatttcactctcaccatcagcagtctgcaacctgaagattttgcaacttactactgtcaacagacttacagtctcccgctcactttcggcggagggaccaaggtggaaatcaaacga

SEQ ID NO: 6290 - protein, 108 aa, Artificial Sequence
  synthetic
DIVMTQSPSSLSASVGDRVTITCRASQTISSYLNWYQQKPGKAPKLLIYGVSNLQSAVPSRFSGSGSGTDFTLTISSLQPEDFATYYCQQTYSLPLTFGGGTKVEIKR

SEQ ID NO: 6291 - DNA, 18 bp, Artificial Sequence
  synthetic
cagaccattagcagctat

SEQ ID NO: 6292 - protein, 6 aa, Artificial Sequence
  synthetic
QTISSY

SEQ ID NO: 6293 - DNA, 9 bp, Artificial Sequence
  synthetic
ggtgtatcc

SEQ ID NO: 6294 - protein, 3 aa, Artificial Sequence
  synthetic
GVS

SEQ ID NO: 6295 - DNA, 27 bp, Artificial Sequence
  synthetic
caacagacttacagtctcccgctcact

SEQ ID NO: 6296 - protein, 9 aa, Artificial Sequence
  synthetic
QQTYSLPLT

SEQ ID NO: 6297 - DNA, 372 bp, Artificial Sequence
  synthetic
gaggtgcagctggtggagtctgggggaggcttggttcagcctggggggtccctgagactctcctgtgcagcctctagattcacctttagcagttatgccatgacctgggtccgccaggctccagggaaggggctggactgggtctccactattagtgcaggtggtactaccacacactacaccccgtccgtgaagggccggttcaccatctccagagacaattccaataaaacgctgtttctgcaaatgagtagcctgagagccgaggactcggccgtatattactgtgcgaagatggatacagctatggccctctattatttctacggtatggacgtctggggccaagggaccacggtcaccgtctcctca

SEQ ID NO: 6298 - protein, 124 aa, Artificial Sequence
  synthetic
EVQLVESGGGLVQPGGSLRLSCAASRFTFSSYAMTWVRQAPGKGLDWVSTISAGGTTTHYTPSVKGRFTISRDNSNKTLFLQMSSLRAEDSAVYYCAKMDTAMALYYFYGMDVWGQGTTVTVSS

SEQ ID NO: 6299 - DNA, 24 bp, Artificial Sequence
  synthetic
agattcacctttagcagttatgcc

SEQ ID NO: 6300 - protein, 8 aa, Artificial Sequence
  synthetic
RFTFSSYA

SEQ ID NO: 6301 - DNA, 24 bp, Artificial Sequence
  synthetic
attagtgcaggtggtactaccaca

SEQ ID NO: 6302 - protein, 8 aa, Artificial Sequence
  synthetic
ISAGGTTT

SEQ ID NO: 6303 - DNA, 51 bp, Artificial Sequence
  synthetic
gcgaagatggatacagctatggccctctattatttctacggtatggacgtc

SEQ ID NO: 6304 - protein, 17 aa, Artificial Sequence
  synthetic
AKMDTAMALYYFYGMDV

SEQ ID NO: 6305 - DNA, 324 bp, Artificial Sequence
  synthetic
gacatcctgatgacccagtctccatccttcctgtctgcatctgtaggagacagagtcaccatcacttgctgggccagtcaggacattaccaattatttagcctggtatcagcgaaaaccagggaaagcccctaaactcctgatctatggtgcatccactttgcaaagtggggtcccatcaaggttcagcggcagtggatctggaacggaattcactctcacaatcagcagcctgcagcctgaggattttgcagtttattactgtcaacagcttgatagttacccgctcactttcggcggagggaccaaggtggagatcaaacga

SEQ ID NO: 6306 - protein, 108 aa, Artificial Sequence
  synthetic
DILMTQSPSFLSASVGDRVTITCWASQDITNYLAWYQRKPGKAPKLLIYGASTLQSGVPSRFSGSGSGTEFTLTISSLQPEDFAVYYCQQLDSYPLTFGGGTKVEIKR

SEQ ID NO: 6307 - DNA, 18 bp, Artificial Sequence
  synthetic
caggacattaccaattat

SEQ ID NO: 6308 - protein, 6 aa, Artificial Sequence
  synthetic
QDITNY

SEQ ID NO: 6309 - DNA, 9 bp, Artificial Sequence
  synthetic
ggtgcatcc

SEQ ID NO: 6310 - protein, 3 aa, Artificial Sequence
  synthetic
GAS

SEQ ID NO: 6311 - DNA, 27 bp, Artificial Sequence
  synthetic
caacagcttgatagttacccgctcact

SEQ ID NO: 6312 - protein, 9 aa, Artificial Sequence
  synthetic
QQLDSYPLT

SEQ ID NO: 6313 - DNA, 372 bp, Artificial Sequence
  synthetic
gaggtgcagctggtggagtctgggggaggtgtggtgcggcctggggggtccctgagactctcctgtgcagcctctggattcacctttgatgattatggcatgagctgggtccgccaagttccagggaaggggctggagtgggtctctggtattaattggaatggtgatagtagaggttatgcagactctgtgaagggccgattcaccatctccagagacaacgccaagaactccctgtatctgcaaatgaacagtctgagagccgaggacacggccttatatttttgtgcgaaagatggtcctgtaacaccagctgatacttactggtacttcgatctctggggccgtggcaccctggtcaccgtctcctca

SEQ ID NO: 6314 - protein, 124 aa, Artificial Sequence
  synthetic
EVQLVESGGGVVRPGGSLRLSCAASGFTFDDYGMSWVRQVPGKGLEWVSGINWNGDSRGYADSVKGRFTISRDNAKNSLYLQMNSLRAEDTALYFCAKDGPVTPADTYWYFDLWGRGTLVTVSS

SEQ ID NO: 6315 - DNA, 24 bp, Artificial Sequence
  synthetic
ggattcacctttgatgattatggc

SEQ ID NO: 6316 - protein, 8 aa, Artificial Sequence
  synthetic
GFTFDDYG

SEQ ID NO: 6317 - DNA, 24 bp, Artificial Sequence
  synthetic
attaattggaatggtgatagtaga

SEQ ID NO: 6318 - protein, 8 aa, Artificial Sequence
  synthetic
INWNGDSR

SEQ ID NO: 6319 - DNA, 51 bp, Artificial Sequence
  synthetic
gcgaaagatggtcctgtaacaccagctgatacttactggtacttcgatctc

SEQ ID NO: 6320 - protein, 17 aa, Artificial Sequence
  synthetic
AKDGPVTPADTYWYFDL

SEQ ID NO: 6321 - DNA, 324 bp, Artificial Sequence
  synthetic
gacatcctgatgacccagtctccttccaccctgtctgcatctgtaggagacagagtcaccatcacttgccgggccagtcagagtattagtacctggttggcctggtatcagcagaaaccagggaaagcccctaagttactgatctatacggcgtctactttagaaagtggggtcccatcaaggttcagcggcagtggatctgggacagaattcactctcaccatcagcagcctacagcctgatgattttgcaacttattactgccaaaattataatagttattcgatcaccttcggccaagggacacgactggagattaaacga

SEQ ID NO: 6322 - protein, 108 aa, Artificial Sequence
  synthetic
DILMTQSPSTLSASVGDRVTITCRASQSISTWLAWYQQKPGKAPKLLIYTASTLESGVPSRFSGSGSGTEFTLTISSLQPDDFATYYCQNYNSYSITFGQGTRLEIKR

SEQ ID NO: 6323 - DNA, 18 bp, Artificial Sequence
  synthetic
cagagtattagtacctgg

SEQ ID NO: 6324 - protein, 6 aa, Artificial Sequence
  synthetic
QSISTW

SEQ ID NO: 6325 - DNA, 9 bp, Artificial Sequence
  synthetic
acggcgtct

SEQ ID NO: 6326 - protein, 3 aa, Artificial Sequence
  synthetic
TAS

SEQ ID NO: 6327 - DNA, 27 bp, Artificial Sequence
  synthetic
caaaattataatagttattcgatcacc

SEQ ID NO: 6328 - protein, 9 aa, Artificial Sequence
  synthetic
QNYNSYSIT

What is claimed is:

1. An isolated antibody or antigen-binding fragment thereof, comprising three heavy chain complementarity determining regions (CDRs) (HCDR1, HCDR2 and HCDR3) contained within a heavy chain variable region (HCVR) comprising the amino acid sequence set forth in SEQ ID NO: 18; and three light chain complementarity determining regions (CDRs) (LCDR1, LCDR2 and LCDR3) contained within a light chain variable region (LCVR) comprising the amino acid sequence set forth in SEQ ID NO: 26.

2. The isolated antibody or antigen-binding fragment thereof of claim 1, comprising a HCVR that comprises an amino acid sequence set forth in SEQ ID NO:18.

3. The isolated antibody or antigen-binding fragment thereof of claim 1, comprising a LCVR that comprises an amino acid sequence set forth in SEQ ID NO: 26.

4. The isolated antibody or antigen-binding fragment thereof of claim 1, comprising a LCVR that comprises an amino acid sequence set forth in SEQ ID NO: 26; and a HCVR that comprises an amino acid sequence set forth in SEQ ID NO: 18.

5. The isolated antibody or antigen-binding fragment thereof of claim 1, comprising:
   (a) a HCDR1 that comprises an amino acid sequence set forth in SEQ ID NO: 20;
   (b) a HCDR2 that comprises an amino acid sequence set forth in SEQ ID NO: 22;
   (c) a HCDR3 that comprises an amino acid sequence set forth in SEQ ID NO: 24;
   (d) a LCDR1 that comprises an amino acid sequence set forth in SEQ ID NO: 28;
   (e) a LCDR2 that comprises an amino acid sequence set forth in SEQ ID NO: 30; and
   (f) a LCDR3 that comprises an amino acid sequence set forth in SEQ ID NO: 32.

6. The isolated antibody or antigen-binding fragment of claim 4 which is an antibody.

7. The isolated antibody of claim 6 which is a recombinant antibody.

8. The isolated antibody of claim 6 which is bispecific.

9. A pharmaceutical composition comprising the isolated antibody of claim 6 and a pharmaceutically acceptable carrier or diluent.

10. The pharmaceutical composition of claim 9 further comprising a second therapeutic agent.

11. An isolated polynucleotide molecule comprising a polynucleotide sequence that encodes a HCVR or an LVCR or both of the antibody of claim 6.

12. A vector comprising the polynucleotide of claim 11.

13. An isolated cell comprising the vector of claim 12.

14. The pharmaceutical composition of claim 10 wherein the second therapeutic agent is an anti-viral drug.

15. The pharmaceutical composition of claim 10 wherein the second therapeutic agent is a neuraminidase inhibitor or an interferon.

16. The pharmaceutical composition of claim 10 wherein the second therapeutic agent is zidovudine, gangcyclovir, vidarabine, idoxuridine, trifluridine, foscarnet, acyclovir, ribavirin, amantadine, remantidine, saquinavir, indinavir, ritonavir, zanamivir, oseltamivir, laninamivir, peramivir or rimantadine.

\* \* \* \* \*